United States Patent 11,446,398 (REGULATED BIOCIRCUIT SYSTEMS) - sequence listing, part 93

SEQ ID NO: 201773 - DNA, 3071 bp, Homo sapiens
  Payload ID: 19808
  Gene Name: zinc finger protein 219
  Uniprot ID: Q9P2Y4
  ENST ID: ENST00000360947
  CDS Start-End: 413-2581
gcaccccgcccctggcggccgcctctcgcggctcccggggtccccagctccctgtccccggagccagagcccggctcccgcgcggctcccagccccgccgcgccgccccccgcatgctaatggccgggccgcctcccgccgcacacaatgcgggccagggccgggggcgggggaccggggagggggcgggggccgggccgggggcgggggggccggggcccggcgcatctcccccggccccacgtaacgctgacgcccgcgccgccggcccgccgcccgccgccgccgccgccgccgccgcccgctccgccgccgcccgcccggggctcctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggccgaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgaggcacagggccctgtgtctgtctgcctacctatgtcctg

SEQ ID NO: 201774 - DNA, 2918 bp, Homo sapiens
  Payload ID: 19808
  Gene Name: zinc finger protein 219
  Uniprot ID: Q9P2Y4
  ENST ID: ENST00000451119
  CDS Start-End: 296-2464
ccactcttccaaggtgtcacaaacagaaaagagctgcagcggacgccactgcaatgtcaaggcaaggcagccaggctgcgctctatcctcactggtgcctggccctggctaggccgggagaagcagcattctctagggaaagaagccttctcaagtgggaacaaaaatgagtgtgaggcgaacagccatcccgggcactatgtgaatttgggctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggccgaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgaggc

SEQ ID NO: 201775 - DNA, 2908 bp, Homo sapiens
  Payload ID: 19808
  Gene Name: zinc finger protein 219
  Uniprot ID: Q9P2Y4
  ENST ID: ENST00000421093
  CDS Start-End: 288-2456
atcaagaacggaaaggaccgaagagtaactttaataatgtttcttatacggccgacattaactatctctataatcgcccctcctcctcccccaaaagagagacagaaattgtaagggagaggctttgagataaaaccccaggaagaacttcccgagtctgtgcatgttggggcagaaagagcggcagagccaactccttccctgctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggccgaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgag

SEQ ID NO: 201776 - DNA, 546 bp, Homo sapiens
  Payload ID: 19808
  Gene Name: zinc finger protein 219
  ENST ID: ENST00000556174
  CDS Start-End: 214-546
gtgcatgttggggcagaaagagcggcagagccaactccttccctggtcttccagaactttcaaaatcaaaatcggggttgcgttaggacatgcctctgggataagattccccatggtgggatggcagcagctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgc

SEQ ID NO: 201777 - DNA, 798 bp, Homo sapiens
  Payload ID: 19808
  Gene Name: zinc finger protein 219
  ENST ID: ENST00000555270
  CDS Start-End: 165-798
cctgcagagaggaggaaagcctgcctcggaacagccctggacaaaggggctcagatgccccatcatactgcaggctccaagctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggccc

SEQ ID NO: 201778 - DNA, 560 bp, Homo sapiens
  Payload ID: 19808
  Gene Name: zinc finger protein 219
  ENST ID: ENST00000553296
  CDS Start-End: 238-560
tttgagtatagcagccccttcgtgcctcaagaagcaagtagggagaatggattggttttgggaatacagaatgctgagagtctgggggtagggagtgactttactgctgaaaactagggctcatcttttcctccaaatctgtctcttgctttagctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacacca

SEQ ID NO: 201779 - DNA, 545 bp, Homo sapiens
  Payload ID: 19808
  Gene Name: zinc finger protein 219
  ENST ID: ENST00000554478
  CDS Start-End: 72-545
aaaagagagacagaaattgtaagggagaggctttgagataaaaccccaggaagaacttcccgagtctgtgcatgttggggcagaaagagcggcagagccaactccttccctgctccacagcacctgttgccttcattagcagcttttcctcctcttccctgcacttcccagaaccaaagaatgtgaagggggtccatggagatctttctccacagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgccca

SEQ ID NO: 201780 - DNA, 654 bp, Homo sapiens
  Payload ID: 19808
  Gene Name: zinc finger protein 219
  ENST ID: ENST00000555697
  CDS Start-End: 561-654
tgcagggtccgggatttggagtggatgggattatgaaaggtggacagaaaagaaaagtgcgatgaggcaaatgtgaagctgtatggggaggtgacaggaagagaggatatggatgcaagggagaaagcagcttttcagggtggtgaggtgaggatatattctcgtccaggtgtatcttcccctaacagggaaggaacgaaaaaagggcctgctttgagtgaaaactgaaggcactcccggacttcctattggactcgaaggatcccagcaagcttctgagtttggtggggtgggatgcaggaatgtctggagagcattctctcagggtggaaggagagcagcacgtgtctgttcccgctgtcccaccctctcatttgctcctgtgctggccaccgtgggaccattctccaaaccaggaacctcttccaactcagagaagccctgaaaaccagagacaggtgtgagcaaattgtagagctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacg

SEQ ID NO: 201781 - DNA, 567 bp, Homo sapiens
  Payload ID: 19808
  Gene Name: zinc finger protein 219
  ENST ID: ENST00000554923
  CDS Start-End: 132-567
agtgtaatcctcctcttgtgtgagggagcctctcccctgcagagaggaggaaagcctgcctcggaacagccctggacaaaggggctcagatgccccatcatactgcaggctccaaggtttgaaacaaggggatgaatcctatacgctccacagcacctgttgccttcattagcagcttttcctcctcttccctgcacttcccagaaccaaagaatgtgaagggggtccatggagatctttctccacagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagc

SEQ ID NO: 201782 - DNA, 576 bp, Homo sapiens
  Payload ID: 19808
  Gene Name: zinc finger protein 219
  ENST ID: ENST00000553980
  CDS Start-End: 406-576
ataatcgcccctcctcctcccccaaaagagagacagaaattgtaagggagaggctttgagataaaaccccaggaagaacttcccgagtctgtgcatgttggggcagaaagagcggcagagccaactccttccctgctccacagcacctgttgccttcattagcagcttttcctcctcttccctgcacttcccagaaccaaagaatgtgaagggggtccatggagaagttaactccttggccctgacatctcgattcccatacacctccccccaccccatcttcccgagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggct

SEQ ID NO: 201783 - DNA, 2551 bp, Homo sapiens
  Payload ID: 19809
  Gene Name: zinc finger protein 22
  Uniprot ID: P17026
  ENST ID: ENST00000298299
  CDS Start-End: 594-1268
gaaatcagactttggagccacaaagaaccattccaattctgggtcgtccgcttacacacggtgaacggagcacatttcttctctgagccttggttcctttcctgtaaatggagtataaccactcccatcttgcaggagctttttggtgataattaaggtgacttcgtgaaaagtaccagggtctcaaaaatctcaaaatttgtggaaagtatgcagtttctaggttggagaggctagagtttggtttcaaaagcctcgaccacacacaggggcggttacagctcttgaggtcccgggggtcacaggacgccttccgagttggggggaggagaaaacaaaaccacaggaagaaacgaacaacgctttcgggtgggcccgggaccatagagggtcgctccgccactttcctagagcgaccgcggcggcgccagagcgcggcgaggccctcacttccggcggcgcgggaggcgcccagcgagccagagtggtggctggtcccgcgcgaaaattctgagctgtacacctctaggaaatgaaacactagttcagaagaagcctgtaaactctcttacaaatacatttggttattcaccatgaggttagcaaagcctaaagcgggtatttctcggagctcaagccaaggaaaggcctatgagaacaagcgcaaaacaggccggcagcggcagaagtggggcatgactattcgatttgactcaagcttcagtagactcagaagaagcttggatgacaaaccctataaatgtactgaatgtgaaaagagtttcagtcagagttcaactctttttcaacaccagaagatccatactggaaagaaatcccataaatgtgctgattgtgggaaaagtttctttcagagttctaatctcattcagcatcgacggatccatacgggggaaaagccctacaaatgtgatgagtgtggagaaagcttcaaacagagctcaaatctcattcagcaccagagaattcatactggagaaaaaccctatcagtgtgatgagtgtggccggtgtttcagccagagctcccaccttattcaacatcagagaacccacactggggagaaaccctaccagtgcagtgaatgtggcaaatgtttcagtcagagctctcatctgaggcagcacatgaaggtgcataaagaagagaagcctcgtaaaacccggggcaaaaatatcagggtgaagactcacttaccctcttggaaagctggtacaggaaggaagtctgtggctggtctccgttaagtatagggctttttgacagctttttgagacctcttaagaaaaaataaaaagtaaaaaatgaaaggaatcttttttagaaatagagatgctttatagtagatcacttaaatactggatcttttgctagtgtgaaaacattgggaatttaatgacattattgagctgaaagaaattacatgagtccagctaccctcatttcttttttatgtgacatggagcacaaagaactgaaaatatgttttgagggagcatgacatccttgacctcatttgaaattacttccattttcaaaaaccatcatgttttgtagatacattttgagaaaaaccatcatgttttgaggatacatttgtgaaagtgcaggcatgccaatgactactcagttttaggactttctgtggaagaaaaaagggagaagaaatcaattccactacttttgaagttctgcaacagatgagattttgtttgtaaagttttgtagtatattaaccattggtttatcactctagattcaacatattaaaatgtattcaagctcacagatttttaatcagtaaggcctatctatattagttgtcttttatttcttctccttgtggacagttgttaatgaaaggagtaaggatttccctttttttgttttgtttgttttgttttttttaaccaaattcttagagatactatagaatccaaatgagaactgaattggacctcaagtcttctattcctactaatagagttctttgtgatggtaactgctgtgtcgtttgttttccacaagttgggatggattcatgtcgatacatccccatgcccttgacctcttctggcattctcctgtgctctgacaaactgagccagccttttagatctacatgaataaacaaactattttaccaagaaaaatctcagcttgcttactgcttaattaaaaacctacaatttacacacctccctgccttcaagactgtgagctttggatagccctgcttaaatgtttgtcaacaacaagagtcgtaatgtgtcagtacattgtagctcctttgaaatttaactctttctgtgttacatgaattgttttaaggagtccggcaaacatgtttcttcacttccatgagaatggtgccaagtgtcagactctaatgagccctcagctcaggttttaatttctattgaatgctaacattcttctgattttttggtatcttttataatcatatcggtttctgctgtattaatgacaattattcatgaaaataaaaaatgaaatattttgtatacta

SEQ ID NO: 201784 - DNA, 2535 bp, Homo sapiens
  Payload ID: 19810
  Gene Name: zinc finger protein 221
  ENST ID: ENST00000251269
  CDS Start-End: 329-2182
gcgggagctacggctgcgggagttaccctttattctgtgatattttgagctgttctgcgtctcgcaggcccttctgaatttcctggacctactctcggaaccctcaacgagctagcgatagatttagaggaaaggaagcaccgtcggaaagcaaagggatttctggaagcttgaacttaagagtgataacttagggtacctggcaaaagaaatttctgagcagcaaagcattcaagaagtggcctggctgcctcactgcttcaaacagcctacaattatatatgggagcaaaaaaatgacttaaagttggaatttatatttaaaaggcatgatttcaccttcacttgaactgcttcattcaggactctgcaaattccctgaagtagaaggaaaaatgaccacattcaaagaggcagtgacattcaaggatgtggctgtggtcttcactgaggaggagctggggctgctggaccctgcccagaggaagctgtaccgagatgtgatgctagagaacttcaggaacctgctctcagtagggaatcaaccattccaccaagatactttccacttcttagggaaggaaaagttttggaagatgaagacaacaagccaaagagaagggaattcaggaggcaagatccaaattgagatggagactgttccagaagcaggaccacatgaagagtggtcctgtcagcaaatatgggaacaaattgcaagtgacctaaccaggtctcaaaactccataaggaacagctctcagttcttcaaagaaggtgatgtcccctgccagattgaggcaagactatctataagtcacgtgcaacagaaaccttaccgttgtaatgaatgtaaacagtccttcagtgatgtttctgtctttgatcttcatcaacaatcacactcaggagagaaatctcatacatgtggtgagtgtggaaaaagcttctgttacagcccagcccttcatattcatcagagagtccatatgggagaaaaatgctataagtgtgatgtgtgtggtaaggaatttaatcagagctcacatctgcaaactcatcagagagtccatactggagagaaaccattcaaatgtgggcaatgtgggaaaggcttccatagtagatcagcacttaatgttcattgcaaattgcacacaggagagaaaccttataattgtgaggaatgtgggaaagccttcattcatgattcacagcttcaagaacatcagagaatccatactggggagaagccattcaaatgtgatatatgtggtaagagcttccgtgttagatcaagacttaataggcattccatggttcacacaggagaaaaaccattcagatgtgatacatgtggcaagaactttcgtcagagatcagcacttaatagtcattccatggtccacatagaagagaagccatacaaatgtgagcaatgtggaaaaggcttcatttgtaggcgagatttttgtaagcatcagatggtccacacaggagagaaaccatataattgtaaagaatgtgggaagaccttcagatggtcctcatgtcttttgaaccatcagcaagtccacagtggacaaaaatccttcaaatgtgaagaatgtgggaagggattttatacaaattcacgacgatcttcccatcagagatcccacaatggagaaaagccatataactgtgaggagtgtggtaaggactataaaaggaggttggatcttgagtttcaccagagggtccacacgggtgagagaccctataattgtaaggaatgtggcaagagctttggctgggcctcctgtcttttgaaacatcagagactccacagtggggaaaaacctttcaaatgtgaagagtgtggaaagagatttactcagagttcacaacttcattcccatcagacatgccatactggagaaaagctatacaaatgtgagcagtgtgagaaggggtacaacagtaaatttaatcttgacatgcaccagagggtccacgggggagagcgaccctataattgtaaggaatgtggaaagagctttggctgggcttcatgtcttttgaaacatcagagactccacagtggagaaaagccattgaaatctggagtgtgggaagagatctactcagaattcacagcttcatttacatcagtaagtctatgtgggagaaaagccatataaatgtgagaagtgtgggaagggctttggctgggcctcaactcatctgacccatcaattctccacagcagagaaaaaccattcaaatatgagaactgtgggaagagctttgtacatagatcatatcttttttttttttttttgagacagagtctcactctttcacccaggcctgactgcagtggcgctatctcagctcactgcaagctccgcctcccaggttcacgccattctcctgcctcagcctcccgagtagctgggactacaggtgcccgccaccacacccagctaattttttgtatttttagtagagacggggtttcaccgtgttagccaggatggtctcgatctcctga

SEQ ID NO: 201785 - DNA, 581 bp, Homo sapiens
  Payload ID: 19810
  Gene Name: zinc finger protein 221
  ENST ID: ENST00000591168
  CDS Start-End: 191-581
agtccagacgctctgtggagtcgcgggagctacggctgcgggagttaccctttattctgtgatattttgagctgttctgcgtctcgcaggcccttctgaatttcctggacctactctcggaaccctcaacgagctagcgatagatttagaggaaaggaagcaccgtcggaaagcaaaggtttggaagggcatgatttcaccttcacttgaactgcttcattcaggactctgcaaattccctgaagtagaaggaaaaatgaccacattcaaagaggcagtgacattcaaggatgtggctgtggtcttcactgaggaggagctggggctgctggaccctgcccagaggaagctgtaccgagatgtgatgctagagaacttcaggaacctgctctcagtagggaatcaaccattccaccaagatactttccacttcttagggaaggaaaagttttggaagatgaagacaacaagccaaagagaagggaattcaggaggcaagatccaaattgagatggagactgttccagaagcaggaccacatgaagagtggtcctgtcagcaaatatgggaacaaattgcaa

SEQ ID NO: 201786 - DNA, 2034 bp, Homo sapiens
  Payload ID: 19810
  Gene Name: zinc finger protein 221
  ENST ID: ENST00000587682
  CDS Start-End: 181-2034
agtccagacgctctgtggagtcgcgggagctacggctgcgggagttaccctttattctgtgatattttgagctgttctgcgtctcgcaggcccttctgaatttcctggacctactctcggaaccctcaacgagctagcgatagatttagaggaaaggaagcaccgtcggaaagcaaaggcatgatttcaccttcacttgaactgcttcattcaggactctgcaaattccctgaagtagaaggaaaaatgaccacattcaaagaggcagtgacattcaaggatgtggctgtggtcttcactgaggaggagctggggctgctggaccctgcccagaggaagctgtaccgagatgtgatgctagagaacttcaggaacctgctctcagtagggaatcaaccattccaccaagatactttccacttcttagggaaggaaaagttttggaagatgaagacaacaagccaaagagaagggaattcaggaggcaagatccaaattgagatggagactgttccagaagcaggaccacatgaagagtggtcctgtcagcaaatatgggaacaaattgcaagtgacctaaccaggtctcaaaactccataaggaacagctctcagttcttcaaagaaggtgatgtcccctgccagattgaggcaagactatctataagtcacgtgcaacagaaaccttaccgttgtaatgaatgtaaacagtccttcagtgatgtttctgtctttgatcttcatcaacaatcacactcaggagagaaatctcatacatgtggtgagtgtggaaaaagcttctgttacagcccagcccttcatattcatcagagagtccatatgggagaaaaatgctataagtgtgatgtgtgtggtaaggaatttaatcagagctcacatctgcaaactcatcagagagtccatactggagagaaaccattcaaatgtgggcaatgtgggaaaggcttccatagtagatcagcacttaatgttcattgcaaattgcacacaggagagaaaccttataattgtgaggaatgtgggaaagccttcattcatgattcacagcttcaagaacatcagagaatccatactggggagaagccattcaaatgtgatatatgtggtaagagcttccgtgttagatcaagacttaataggcattccatggttcacacaggagaaaaaccattcagatgtgatacatgtggcaagaactttcgtcagagatcagcacttaatagtcattccatggtccacatagaagagaagccatacaaatgtgagcaatgtggaaaaggcttcatttgtaggcgagatttttgtaagcatcagatggtccacacaggagagaaaccatataattgtaaagaatgtgggaagaccttcagatggtcctcatgtcttttgaaccatcagcaagtccacagtggacaaaaatccttcaaatgtgaagaatgtgggaagggattttatacaaattcacgacgatcttcccatcagagatcccacaatggagaaaagccatataactgtgaggagtgtggtaaggactataaaaggaggttggatcttgagtttcaccagagggtccacacgggtgagagaccctataattgtaaggaatgtggcaagagctttggctgggcctcctgtcttttgaaacatcagagactccacagtggggaaaaacctttcaaatgtgaagagtgtggaaagagatttactcagagttcacaacttcattcccatcagacatgccatactggagaaaagctatacaaatgtgagcagtgtgagaaggggtacaacagtaaatttaatcttgacatgcaccagagggtccacgggggagagcgaccctataattgtaaggaatgtggaaagagctttggctgggcttcatgtcttttgaaacatcagagactccacagtggagaaaagccattgaaatctggagtgtgggaagagatctactcagaattcacagcttcatttacatcagtaagtctatgtgggagaaaagccatataa

SEQ ID NO: 201787 - DNA, 2329 bp, Homo sapiens
  Payload ID: 19810
  Gene Name: zinc finger protein 221
  ENST ID: ENST00000592350
  CDS Start-End: 232-2085
ggctgcctcactgcttcaaacagcctacaattatatatgggagcaaaaaaatgacttaaagttggaatttatatttaaaaggttcagattatgcattgttggtgtggataccacagaagtgttgaagtgtcataacaggggccaaatgatgtctgtttttcccttcattggagatctcaactttgttcacttggccaagatgatatctttcagatttttccactgaaaggcatgatttcaccttcacttgaactgcttcattcaggactctgcaaattccctgaagtagaaggaaaaatgaccacattcaaagaggcagtgacattcaaggatgtggctgtggtcttcactgaggaggagctggggctgctggaccctgcccagaggaagctgtaccgagatgtgatgctagagaacttcaggaacctgctctcagtagggaatcaaccattccaccaagatactttccacttcttagggaaggaaaagttttggaagatgaagacaacaagccaaagagaagggaattcaggaggcaagatccaaattgagatggagactgttccagaagcaggaccacatgaagagtggtcctgtcagcaaatatgggaacaaattgcaagtgacctaaccaggtctcaaaactccataaggaacagctctcagttcttcaaagaaggtgatgtcccctgccagattgaggcaagactatctataagtcacgtgcaacagaaaccttaccgttgtaatgaatgtaaacagtccttcagtgatgtttctgtctttgatcttcatcaacaatcacactcaggagagaaatctcatacatgtggtgagtgtggaaaaagcttctgttacagcccagcccttcatattcatcagagagtccatatgggagaaaaatgctataagtgtgatgtgtgtggtaaggaatttaatcagagctcacatctgcaaactcatcagagagtccatactggagagaaaccattcaaatgtgggcaatgtgggaaaggcttccatagtagatcagcacttaatgttcattgcaaattgcacacaggagagaaaccttataattgtgaggaatgtgggaaagccttcattcatgattcacagcttcaagaacatcagagaatccatactggggagaagccattcaaatgtgatatatgtggtaagagcttccgtgttagatcaagacttaataggcattccatggttcacacaggagaaaaaccattcagatgtgatacatgtggcaagaactttcgtcagagatcagcacttaatagtcattccatggtccacatagaagagaagccatacaaatgtgagcaatgtggaaaaggcttcatttgtaggcgagatttttgtaagcatcagatggtccacacaggagagaaaccatataattgtaaagaatgtgggaagaccttcagatggtcctcatgtcttttgaaccatcagcaagtccacagtggacaaaaatccttcaaatgtgaagaatgtgggaagggattttatacaaattcacgacgatcttcccatcagagatcccacaatggagaaaagccatataactgtgaggagtgtggtaaggactataaaaggaggttggatcttgagtttcaccagagggtccacacgggtgagagaccctataattgtaaggaatgtggcaagagctttggctgggcctcctgtcttttgaaacatcagagactccacagtggggaaaaacctttcaaatgtgaagagtgtggaaagagatttactcagagttcacaacttcattcccatcagacatgccatactggagaaaagctatacaaatgtgagcagtgtgagaaggggtacaacagtaaatttaatcttgacatgcaccagagggtccacgggggagagcgaccctataattgtaaggaatgtggaaagagctttggctgggcttcatgtcttttgaaacatcagagactccacagtggagaaaagccattgaaatctggagtgtgggaagagatctactcagaattcacagcttcatttacatcagtaagtctatgtgggagaaaagccatataaatgtgagaagtgtgggaagggctttggctgggcctcaactcatctgacccatcaattctccacagcagagaaaaaccattcaaatatgagaactgtgggaagagctttgtacatagatcatatcttttttttttttttttgagacagagtctcactctttcacccaggcctgactgcagtggcgctatctcagctcactgcaagctccgcctcccaggttcacgccattctcctgcctcagcct

SEQ ID NO: 201788 - DNA, 2102 bp, Homo sapiens
  Payload ID: 19810
  Gene Name: zinc finger protein 221
  ENST ID: ENST00000622072
  CDS Start-End: 5-1858
aggcatgatttcaccttcacttgaactgcttcattcaggactctgcaaattccctgaagtagaaggaaaaatgaccacattcaaagaggcagtgacattcaaggatgtggctgtggtcttcactgaggaggagctggggctgctggaccctgcccagaggaagctgtaccgagatgtgatgctagagaacttcaggaacctgctctcagtagggaatcaaccattccaccaagatactttccacttcttagggaaggaaaagttttggaagatgaagacaacaagccaaagagaagggaattcaggaggcaagatccaaattgagatggagactgttccagaagcaggaccacatgaagagtggtcctgtcagcaaatatgggaacaaattgcaagtgacctaaccaggtctcaaaactccataaggaacagctctcagttcttcaaagaaggtgatgtcccctgccagattgaggcaagactatctataagtcacgtgcaacagaaaccttaccgttgtaatgaatgtaaacagtccttcagtgatgtttctgtctttgatcttcatcaacaatcacactcaggagagaaatctcatacatgtggtgagtgtggaaaaagcttctgttacagcccagcccttcatattcatcagagagtccatatgggagaaaaatgctataagtgtgatgtgtgtggtaaggaatttaatcagagctcacatctgcaaactcatcagagagtccatactggagagaaaccattcaaatgtgggcaatgtgggaaaggcttccatagtagatcagcacttaatgttcattgcaaattgcacacaggagagaaaccttataattgtgaggaatgtgggaaagccttcattcatgattcacagcttcaagaacatcagagaatccatactggggagaagccattcaaatgtgatatatgtggtaagagcttccgtgttagatcaagacttaataggcattccatggttcacacaggagaaaaaccattcagatgtgatacatgtggcaagaactttcgtcagagatcagcacttaatagtcattccatggtccacatagaagagaagccatacaaatgtgagcaatgtggaaaaggcttcatttgtaggcgagatttttgtaagcatcagatggtccacacaggagagaaaccatataattgtaaagaatgtgggaagaccttcagatggtcctcatgtcttttgaaccatcagcaagtccacagtggacaaaaatccttcaaatgtgaagaatgtgggaagggattttatacaaattcacgacgatcttcccatcagagatcccacaatggagaaaagccatataactgtgaggagtgtggtaaggactataaaaggaggttggatcttgagtttcaccagagggtccacacgggtgagagaccctataattgtaaggaatgtggcaagagctttggctgggcctcctgtcttttgaaacatcagagactccacagtggggaaaaacctttcaaatgtgaagagtgtggaaagagatttactcagagttcacaacttcattcccatcagacatgccatactggagaaaagctatacaaatgtgagcagtgtgagaaggggtacaacagtaaatttaatcttgacatgcaccagagggtccacgggggagagcgaccctataattgtaaggaatgtggaaagagctttggctgggcttcatgtcttttgaaacatcagagactccacagtggagaaaagccattgaaatctggagtgtgggaagagatctactcagaattcacagcttcatttacatcagtaagtctatgtgggagaaaagccatataaatgtgagaagtgtgggaagggctttggctgggcctcaactcatctgacccatcaattctccacagcagagaaaaaccattcaaatatgagaactgtgggaagagctttgtacatagatcatatcttttttttttttttttgagacagagtctcactctttcacccaggcctgactgcagtggcgctatctcagctcactgcaagctccgcctcccaggttcacgccattctcctgcctcagcct

SEQ ID NO: 201789 - DNA, 1598 bp, Homo sapiens
  Payload ID: 19811
  Gene Name: zinc finger protein 222
  Uniprot ID: Q9UK12
  ENST ID: ENST00000187879
  CDS Start-End: 163-1518
gtagtttgagtcatttccacatcttgcgagtccttccgaacgagtctcctttccttggggctcgcaaccacccaatgatcgattcaggagaaaagaagcctgggcggagagcagagcccgacctttctaaaagagctgcaggaagggacttcttggctactgatggcaaagctctacgaggcagtgaccttcaaggatgtggctgtgatcttcactgaggaggagctggggctgctggaccctgcccagaggaagctgtaccgagatgtgatgcttgagaacttcaggaacctgctctcagtgggaggcaagatccaaactgagatggagactgttccagaagcaggaacacatgaagaattttcctgcaagcaaatttgggaacaaattgcaagtgacttaaccaggtctcaagataccaccataagtaactctcagttatttgaacaagatgacaacccctcccagattaaagcaagactatctacagttcacacaagagaaaaacctttccagggtgaaaattgtaaacagttcttcagtgatgtttccttctttgatcttcctcagcagttatattcaggagagaagtctcatacctgtgatgagtgtggaaaaagcttctgttacatctcagcccttcatattcatcagagggtccacatgggagtgaaatgctataagtgtgatgtgtgtggtaaggaatttagtcagagctcacgtctgcaaactcatcaaagagtccacactggagagaaaccattcaaatgtgagcagtgtgggaaaggcttcagatgtagatcagcacttaaagttcattgcaaattacacatgagagagaaaccttataattgtgagaaatgtgggaaggctttcatgcacaatttccagcttcagaaacatcacagaattcatactggggagaagccattcaaatgtgaaatatgtggtaagagcttctgtcttaggtcaagtcttaataggcattgcatggtccacacagcagagaaactgtacaaatctgaaaagtatggaagaggtttcattgataggctagatttgcataagcatcagatgattcatatgggacagaaaccatataattgtaaagaatgtgggaagagcttcaaatggtcctcatatcttttggtccatcaacgagtccacactggagaaaagccatacaaatgtgaggagtgtgggaagggctacattagtaagtcaggtcttgacttccaccatagaacccacacgggagagagatcttataactgtgataactgcgggaagagctttagacatgcttctagtattttgaatcataagaaactccactgccaaagaaagccattgaaatgtgaagactgtggaaagaggcttgtatgccggtcatactgtaaagaccaacaaagagaccacagtggagaaaacccatccaaatgtgaggactgtgggaagcgctacaagaggcgcttgaatctggatataattttatcattatttttaaatgacatataagttatacatatttatggagtgtgaaatttgatacatgtatataatgtgtgctgattaaatcagtttaatttcacctgaaa

SEQ ID NO: 201790 - DNA, 1595 bp, Homo sapiens
  Payload ID: 19811
  Gene Name: zinc finger protein 222
  Uniprot ID: Q9UK12
  ENST ID: ENST00000391960
  CDS Start-End: 38-1513
gaacgagtctcctttccttggggctcgcaaccacccaatgatcgattcaggagaaaagaagcctgggcggagagcagaggaggcagtgaccttcaaggatgtggctgtgatcttcactgaggaggagctggggctgctggaccctgcccagaggaagctgtaccgagatgtgatgcttgagaacttcaggaacctgctctcagtggggcatcaaccattccatggagatactttccacttcctaagggaagaaaagttttgggtgatggggacaacaagccaaagagaagggaatttgggaggcaagatccaaactgagatggagactgttccagaagcaggaacacatgaagaattttcctgcaagcaaatttgggaacaaattgcaagtgacttaaccaggtctcaagataccaccataagtaactctcagttatttgaacaagatgacaacccctcccagattaaagcaagactatctacagttcacacaagagaaaaacctttccagggtgaaaattgtaaacagttcttcagtgatgtttccttctttgatcttcctcagcagttatattcaggagagaagtctcatacctgtgatgagtgtggaaaaagcttctgttacatctcagcccttcatattcatcagagggtccacatgggagtgaaatgctataagtgtgatgtgtgtggtaaggaatttagtcagagctcacgtctgcaaactcatcaaagagtccacactggagagaaaccattcaaatgtgagcagtgtgggaaaggcttcagatgtagatcagcacttaaagttcattgcaaattacacatgagagagaaaccttataattgtgagaaatgtgggaaggctttcatgcacaatttccagcttcagaaacatcacagaattcatactggggagaagccattcaaatgtgaaatatgtggtaagagcttctgtcttaggtcaagtcttaataggcattgcatggtccacacagcagagaaactgtacaaatctgaaaagtatggaagaggtttcattgataggctagatttgcataagcatcagatgattcatatgggacagaaaccatataattgtaaagaatgtgggaagagcttcaaatggtcctcatatcttttggtccatcaacgagtccacactggagaaaagccatacaaatgtgaggagtgtgggaagggctacattagtaagtcaggtcttgacttccaccatagaacccacacgggagagagatcttataactgtgataactgcgggaagagctttagacatgcttctagtattttgaatcataagaaactccactgccaaagaaagccattgaaatgtgaagactgtggaaagaggcttgtatgccggtcatactgtaaagaccaacaaagagaccacagtggagaaaacccatccaaatgtgaggactgtgggaagcgctacaagaggcgcttgaatctggatataattttatcattatttttaaatgacatataagttatacatatttatggagtgtgaaatttgatacatgtatataatgtgtgctgattaaatcagtttaatttcacctgaaaca

SEQ ID NO: 201791 - DNA, 537 bp, Homo sapiens
  Payload ID: 19811
  Gene Name: zinc finger protein 222
  ENST ID: ENST00000587846
  CDS Start-End: 96-368
gttgctatttcatttaccacagtagtttgagtcatttccacatcttgcgagtccttccgaacgagtctcctttccttggggctcgcaaccacccaatgatcgattcaggagaaaagaagcctgggcggagagcagaggaggcagtgaccttcaaggatgtggctgtgatcttcactgaggaggagctggggctgctggaccctgcccagaggaagctgtaccgagatgtgatgcttgagaacttcaggaacctgctctcagtggggcatcaaccattccatggagatactttccacttcctaagggaagaaaagttttgggtgatggggacaacaagccaaagagaagggaatttgggtcccttgtgatagtattcatcactcctggatgattcaggatgaccctcccactttctgcttagctggctagtgacctcaatggcatctgtagctttaatctcccttgctgtggaacataacgtgttcataggttctgaggactggatgtagacatctttcaggaatgattattttctct

SEQ ID NO: 201792 - DNA, 2418 bp, Homo sapiens
  Payload ID: 19812
  Gene Name: zinc finger protein 223
  Uniprot ID: Q9UK11
  ENST ID: ENST00000434772
  CDS Start-End: 256-1704
gcgcagagaggacacttccggtctcctagtctgaggttcctgctttaatgaccggggtagtttgagccatttctgcgtcttgcaggacattttgaacgaaccccctttgcttgaggctcgcaaccacccgatgatcgatgatcgtctcaggggaaaagaagccttggcgaagagcagaggtttagaggcacaattctgctttccctggaactgtgtcattcaggactctgcaaattccctaaagtaggaggaaaaatgaccatgtccaaggaggcagtgaccttcaaggatgtggcagtggtcttcactgaggaggagctggggctgctggaccttgcccagaggaagctgtatcgagatgtgatgctggagaacttcaggaacctgctgtcagtggggcatcaaccattccaccgagatactttccactttctaagggaggaaaagttttggatgatggatatagcaacccaaagggaagggaattcaggaggcaagatccaacctgagatgaagacttttccagaagcaggaccacatgaagggtggtcctgccagcagatctgggaagaaattgcaagtgatttaaccaggcctcaagactctaccataaagagctctcagttctttgaacagggtgatgcccactcccaggttgaggaaggactatctataatgcacacaggacagaaaccttccaattgtgggaagtgtaaacaatccttcagtgatatgtccatctttgatcttcctcagcaaatacgctcagcagagaagtctcattcctgtgatgagtgtggaaaaagcttctgttacatctcagcgcttcatattcatcagagagtccacctgggagagaaactctttaagtgtgacgtgtgtggtaaggaattcagtcagagtttacatctgcaaactcatcagagagtccatactggagagaaacctttcaaatgtgaacaatgtgggagaggcttcagatgtagatcagcacttacagttcattgcaaattacacatgggagagaaacattataattgtgaggcatgtgggagggccttcattcatgatttccagcttcagaaacatcagagaattcacacaggggagaagccattcaaatgtgagatatgtagtgtgagcttccgtcttaggtcaagtcttaataggcattgtgtggtccacacaggaaagaaaccaaacagcactggggaatatggaaaaggcttcattcgtaggctggatttgtgtaagcatcagacgatccacacaggagagaaaccatataattgtaaagaatgtgggaagagcttcagacggtcctcctatcttttgatccatcagcgagtccacactggagaaaagccatacaaatgtgacaagtgtgggaagagctacattactaagtcaggtcttgacttgcaccatagagcccacacaggagagagaccttataactgtgatgactgtgggaagagctttagacaggcctcaagtattttgaatcataagagactccattgccgaaaaaaaccattcaaatgtgaggattgtggaaagaagcttgtataccggtcataccgtaaagaccaacaaaaaaaccacagtggagaaaatccatccaaatgtgaagactgtgggaagcgctacaagaggcgcttgaatcttgatataattttatcattatttttaaatgacacgtaagtgttgtacatatttatggggtacagtgtgatatttaaatatatgtatatgatgtataatgatcaaatcagtgtaattagcacatttatcacctcaattatctcttttttgtgttgagaaaattaaaaattcattgttccagcagtttgaaaataaattgttgtcgatgatagtcacctttagtgctgcagaacagcagaacttcttcctcttatctacctgtacttttgcatccattagccaacctttggccatcccacctatcccttacccttccctgcctctagagccactgttctcactacttctaagaaatcagctttttaagcttccccatgtgattgaggacagtttgaagttagtgtttcagccatagctcagcataccccagtggtcgtgggactgtcagagcagagaatgctgcagggtttctaacagaagtttgacaattagttattattcaggagacaggtcttagtataagagtttgttcacacactttcaaaacactaatgatgaacatgtcaaaattgatgaccactagaatgtcagccacatgtgtctttgtatttttgctgcatccttacattgcttgagtctggaagattgaggctgcactgacctatggtagtgctactgcactccagccagggcaacagagtgagaccctgtctccaaaaaaaaaaattaaataaatacctttctttgtttcta

SEQ ID NO: 201793 - DNA, 541 bp, Homo sapiens
  Payload ID: 19812
  Gene Name: zinc finger protein 223
  ENST ID: ENST00000585552
  CDS Start-End: 224-493
gaggttcctgctttaatgaccggggtagtttgagccatttctgcgtcttgcaggacattttgaacgaaccccctttgcttgaggctcgcaaccacccgatgatcgatgatcgtctcaggggaaaagaagccttggcgaagagcagaggtttagaggcacaattctgctttccctggaactgtgtcattcaggactctgcaaattccctaaagtaggaggaaaaatgaccatgtccaaggaggcagtgaccttcaaggatgtggcagtggtcttcactgaggaggagctggggctgctggaccttgcccagaggaagctgtatcgagatgtgatgctggagaacttcaggaacctgctgtcagtggggcatcaaccattccaccgagatactttccactttctaagggaggaaaagttttggatgatggatatagcaacccaaagggaagggaattcaggtaagaagcacgcaactgtgtgtccttgtttgtgacttccatctgttttacttctgtgcacgtccaactccattaccttcttc

SEQ ID NO: 201794 - DNA, 850 bp, Homo sapiens
  Payload ID: 19812
  Gene Name: zinc finger protein 223
  ENST ID: ENST00000591850
  CDS Start-End: 185-850
tttccatttttcctcttggcctcctcaatgttccttctctcccagtaaccattggtagtgagattgaggttgcatatgtttgatgctgtaggaggcagtgaccttcaaggatgtggcagtggtcttcactgaggaggagctggggctgctggaccttgcccagaggaagctgtatcgagatgtgatgctggagaacttcaggaacctgctgtcagtggggcatcaaccattccaccgagatactttccactttctaagggaggaaaagttttggatgatggatatagcaacccaaagggaagggaattcaggaggcaagatccaacctgagatgaagacttttccagaagcaggaccacatgaagggtggtcctgccagcagatctgggaagaaattgcaagtgatttaaccaggcctcaagactctaccataaagagctctcagttctttgaacagggtgatgcccactcccaggttgaggaaggactatctataatgcacacaggacagaaaccttccaattgtgggaagtgtaaacaatccttcagtgatatgtccatctttgatcttcctcagcaaatacgctcagcagagaagtctcattcctgtgatgagtgtggaaaaagcttctgttacatctcagcgcttcatattcatcagagagtccacctgggagagaaactctttaagtgtgacgtgtgtggtaaggaattcagtcagagtttacatctgcaaactcatcagagagtccatactggagagaaacctttcaaatgtgaacaatgtgggagaggcttcagatgtagatcagcacttacagttcattgcaaattacacatgggagagaaa

SEQ ID NO: 201795 - DNA, 895 bp, Homo sapiens
  Payload ID: 19812
  Gene Name: zinc finger protein 223
  ENST ID: ENST00000593088
  CDS Start-End: 203-481
ggggtagtttgagccatttctgcgtcttgcaggacattttgaacgaaccccctttgcttgaggctcgcaaccacccgatgatcgatgatcgtctcaggggaaaagaagccttggcgaagagcagaggtttagaggcacaattctgctttccctggaactgtgtcattcaggactctgcaaattccctaaagtaggaggaaaaatgaccatgtccaaggaggcagtgaccttcaaggatgtggcagtggtcttcactgaggaggagctggggctgctggaccttgcccagaggaagctgtatcgagatgtgatgctggagaacttcaggaacctgctgtcagtggggcatcaaccattccaccgagatactttccactttctaagggaggaaaagttttggatgatggatatagcaacccaaagggaagggaattcaggagggagtgtgcaagcgagcaagtgcaggaaccggagcaaatgaatgctggaattggctggtcgctcctctctggcgagagcaggctctgttatgcacgccccacagcagtgtccaagcatgttacaacccatgctgtttcagctctgccatctggggatggccaagtgccaatcagctcagtggagcatcagggtagcagcccctgccctcttggcacctgggttcttgtccagcatccaggaagaaccaggtcacatgaactgtgtgaaaggtgatgaacgcagaagactttattgagtggaggcaagatccaacctgagatgaagacttttccagaagcaggaccacatgaagggtggtcctgccagcagatctgggaagaaattgcaagtgatttaaccaggcctcaagactctaccataaagagctctcagttctttgaacagggtgatgccc

SEQ ID NO: 201796 - DNA, 3980 bp, Homo sapiens
  Payload ID: 19813
  Gene Name: zinc finger protein 224
  Uniprot ID: Q9NZL3
  ENST ID: ENST00000336976
  CDS Start-End: 255-2378
ggttgctgcagtttttccgcgatagtttggggcagttccgcgcgttgcaggcccttctgaatttcctggacctacgcattggatcctcaaagaactgctgaataccactagaaacatacctgtaaccagagacagctgattatagctttctgcagcaaggaagcccacgtaccaggggctgtcttggcacaattctgctttcccaggaactgcatcactcaggactctgcaagtttccagaagtaagagggaaaatgaccacgttcaaggaggcaatgaccttcaaggacgtggctgtggtcttcactgaggaagagctggggctgctggaccttgctcagaggaagctgtatcgagatgtgatgctggagaacttcaggaacctgctctcagtgggacatcaagcattccacagggatactttccacttcctaagggaagaaaagatttggatgatgaagacagcaatccaaagggaagggaattcaggagacaagatccaaactgagatggagactgtttcagaagcaggaacacatcaagagtggtccttccagcaaatctgggaaaaaattgcaagtgatttaaccaggtctcaagacttgatgataaatagctctcagttctccaaagaaggtgatttcccctgccagactgaggcaggactatctgtaattcacacaagacagaaatcttcccagggcaatggatataaaccatccttcagtgatgtctcccactttgattttcatcaacaattacactcaggagagaaatctcatacgtgtgatgagtgtggaaagaacttttgttacatctcagcccttcgtattcatcagagagtccacatgggagagaaatgctataagtgtgacgtgtgtggtaaggaattcagtcagagttcacatctgcaaactcatcagagagtccacactggagagaaaccgttcaaatgtgtggaatgtgggaaaggcttcagtcgtagatcagcacttaatgttcatcataaattacacacaggagagaaaccttataattgtgaggaatgcgggaaggccttcattcacgattcccagcttcaagaacatcagagaatccatacgggggagaagccattcaaatgtgatatatgtggtaagagcttctgtggtagatcaagacttaataggcattccatggttcacacggcagagaaaccattccgatgtgatacgtgtgataagagctttcgtcagagatcagcacttaatagtcatcgcatgatccacacaggagagaaaccatacaaatgtgaggagtgtggaaaaggctttatttgtaggcgagatctttatacgcatcatatggtccacacgggagaaaagccatataattgtaaagagtgtgggaagagcttcagatgggcctcgtgtcttttgaaacatcagcgagtccacagtggagaaaaaccattcaaatgtgaagaatgtgggaaaggattttacacaaattcacaatgctattcccaccagagatcccatagtggagaaaaaccatacaaatgtgtggagtgtgggaagggctacaaaaggaggttggatcttgactttcaccagcgcgtccatacaggagagaaactgtataattgtaaggaatgtgggaagagctttagtcgggccccatgtcttttgaaacatgagagactccacagtggagaaaaaccattccaatgtgaagagtgtgggaagagatttactcaaaattcacatcttcattcccatcagagagttcacactggagaaaagccatacaaatgtgagaagtgtggaaagggctacaatagtaagtttaatcttgatatgcaccagaaggtccacacaggagagagaccatacaattgtaaggaatgtgggaagagttttggctgggcctcgtgtcttttgaaacatcagagactgcacagtggagaaaaaccattcaaatgtgaagagtgtgggaaaagatttactcagaattcacagcttcattctcatcaaagagtgcacactggagaaaagccatacaaatgtgatgagtgtgggaagggcttcagctggtcctcaactcgtctgacccatcagagacgccacagcagagaaacacctctcaaatgtgagcagcatgggaagaacattgtacagaattcattctctaaagtgcaagaaaaagttcacagtgtagaaaagccatacaaatgtgaggactgtgggaagggctacaacaggcgcttgaatcttgatatgcatcagagggtccacatgggagagaaaacatggaagtgtagggagtgtgatatgtgctttagtcaggcctcaagccttcgacttcatcagaatgttcatgttggagaaaaaccttagtgatgtgatggtgcaataaagtcttcactcagtcttcatgaatgcagtctcatctgaaagttcacaaaggagagacacattaaaatatgaggcacatagtaagcacttccctttgagtattttatctctgaatccatgctggtgataaatttcacccattcttggaagagggaaaacatttgtttaagataacatcagtgcttcagccatagctcagcatgccccagtagtctcaggaccaccataatggagaatccttgtaaatggtgcaataaagcttcattcagaagtttgataattacagctatcattcaggagacaggccttagaaagagtaagagttcatgaatttaccagactaatggtggacatgtccaaattgatgtccactagaatgtaaactacatgtgtctttgctgctaagtcgtcacagccttaacattgattagcactttgtatgtgttcagtacttgtttgttaaatcaatgaaaggataaaacatatgtatggatttggatacaattttgtgtatccaaaaagggaagcctgcaaaaaataattctgggaaacatgagttgaaatgcagagtaaactcagtactgcaatccatagcaatattttgcatattattattttttcttttaaatttttttcttgatcagatttatcatattcattgaacattattttattgcacttggctcctggcttccccccatcctgtgctctgaagtcagagtattatttgtggctctatgaaatgtccattgcttgtatacggtataaatttaattatcttttgtagtttttctcacagtatagactgaaaaggtttggttaattttgcaataacagaccactgcatatttcacaattaagtgttttcaacagtattaaggcaagatttacagtaacacttttaaagtgccagatgtacattgacagaaattttcttagtcaatcctagattgatcatgatttgtgatttctatgcaggccttggtatgattgccttttaattgctgtacaatttcttttttttttttaacttctctggtataaaatattctaaatttgaatgacagcttttgtcaaccttcttatccaatattcttccaccaacgctatgaaacaggaagagaaaatggagtttggtaatttcatcaaatatattcattattgggggcaggagtaacatttaaatcctcctctttattgctggcagtaaaaatatgtcttttggagagcagaacatgccagaatgtataaggtgcaactgtttgatatgaaaaccataggataggaaactatgcctatgacactaaaactccaaaaagtagaagaccacattgatgatgtcactgcattttaaaatggaaagaacaagtgttcaagaacaggaatttgtgtgaattgcatttattcctataataatatgaactcaatgagatgatgacatagacacaataacaaaaggagaaaaacaatgtggctttttttagccttcataacctaatcaaataaatatctttgtgtgttttatgttcttttgagtgtttacatactgtgtaaatgaatatttttactgatctttgctggcaa

SEQ ID NO: 201797 - DNA, 547 bp, Homo sapiens
  Payload ID: 19813
  Gene Name: zinc finger protein 224
  ENST ID: ENST00000589680
  CDS Start-End: 350-547
aagtggagtccaaacattcggtggagtcgcggacacttccgctcggggactgaggttgctgcagtttttccgcgatagtttggggcagttccgcgcgttgcaggcccttctgaatttcctggacctacgcattggatcctcaaagaactggtgatcgaattaggggaaaaggggcctcgtcggagagtagagctgaataccactagaaacatacctgtaaccagagacagctgattatagctttctgcagcaaggaagcccacgtaccaggggctgtcttggcacaattctgctttcccaggaactgcatcactcaggactctgcaagtttccagaagtaagagggaaaatgaccacgttcaaggaggcaatgaccttcaaggacgtggctgtggtcttcactgaggaagagctggggctgctggaccttgctcagaggaagctgtatcgagatgtgatgctggagaacttcaggaacctgctctcagtgggacatcaagcattccacagggatactttccacttcctaagggaagaaaagatttgg

SEQ ID NO: 201798 - DNA, 614 bp, Homo sapiens
  Payload ID: 19813
  Gene Name: zinc finger protein 224
  ENST ID: ENST00000589870
  CDS Start-End: 455-614
tttacaaatttttataatttttttcttaatatttcccccttatgtgtttaactatggaaatttccaaatgctgacagactaaactagtgaattatcatgttatatcatactcattaatctcattattgttattatttttcctatgactgtttcctaaaattataaaactttttattttcatgtcatttgaaacctatagaaaagttgcaaaagtagcctaagaaattcttatttactctttacccacgtttgccaagtgtttacatttttcctgtttgttttgttgatgaccatcagctgaataccactagaaacatacctgtaaccagagacagctgattatagctttctgcagcaaggaagcccacgtaccaggggctgtcttggcacaattctgctttcccaggaactgcatcactcaggactctgcaagtttccagaagtaagagggaaaatgaccacgttcaaggaggcaatgaccttcaaggacgtggctgtggtcttcactgaggaagagctggggctgctggaccttgctcagaggaagctgtatcgagatgtgatgctggagaacttcaggaacctgctctcagtgggacatcaagcattccaca

SEQ ID NO: 201799 - DNA, 538 bp, Homo sapiens
  Payload ID: 19813
  Gene Name: zinc finger protein 224
  ENST ID: ENST00000591511
  CDS Start-End: 166-538
agtcatgtgccaattcacaatacacatccctgttggtgggtggcatccctggccaccttttcatgtctctttttctgcctttcctggcactttgcaggcacaattctgctttcccaggaactgcatcactcaggactctgcaagtttccagaagtaagagggaaaatgaccacgttcaaggaggcaatgaccttcaaggacgtggctgtggtcttcactgaggaagagctggggctgctggaccttgctcagaggaagctgtatcgagatgtgatgctggagaacttcaggaacctgctctcagtgggacatcaagcattccacagggatactttccacttcctaagggaagaaaagatttggatgatgaagacagcaatccaaagggaagggaattcaggagacaagatccaaactgagatggagactgtttcagaagcaggaacacatcaagagtggtccttccagcaaatctgggaaaaaattgcaagtgatttaaccaggtctcaagacttgatgataaatagctctcagttct

SEQ ID NO: 201800 - DNA, 4482 bp, Homo sapiens
  Payload ID: 19814
  Gene Name: zinc finger protein 225
  Uniprot ID: Q9UK10
  ENST ID: ENST00000262894
  CDS Start-End: 281-2401
agtttgtctcaggaattctgggaagtggagtccagacactcagtggagtagcgggccacttccgctccgttactgtgaggttgctgcagttttgtccctggtagtttgggtcagttccgcgagacccttctgaatttcctggacctacgcattggatccttaacgaactggtgatcgaattaggggaaaagaaacctcgtcggagagcagaggcaggattctgctttcccttggactgtatcactcaggactctgaatattccctgaaataggaggaaaaatgaccacgttgaaggaggcagtgaccttcaaggacgtggctgtggtcttcactgaggaagagctgaggctgctggaccttgcccagaggaaactgtaccgagaagtgatgctggagaacttcaggaacctgctctcagtggggcatcaatcactccacagagatactttccacttcctaaaggaagaaaagttttggatgatggagacagcaacccaaagagaagggaatttaggaggcaagatccaaatggagatggagactgtttcagaatcaggaacacatgaaggcttgttcagtcatcaaacctgggaacaaatttcaagtgacttaaccaggtttcaagactccatggtaaacagctttcagttctccaaacaagatgatatgccctgccaggttgatgcaggactatctataattcacgtaagacagaaaccttctgagggtaggacgtgtaaaaagtcctttagtgatgtctccgtccttgatcttcatcaacaactacagtcaagagagaagtctcatacatgtgatgaatgtggaaagagtttctgttatagctcagctcttcgtattcatcagagagttcacatgggggagaaactctataattgtgatgtgtgtggtaaggaattcaatcagagctcacatctgcaaattcatcagagaatccacactggagagaaaccattcaaatgtgagcagtgtgggaaaggctttagtcgtagatcaggactttatgttcatcgtaaattacacacaggagtgaaacctcatatttgtgagaaatgtgggaaggccttcattcatgattcccagcttcaggaacatcaaagaatccatactggggagaagccattcaaatgtgatatatgttgtaagagcttccgtagtagagcaaatcttaataggcattccatggttcacatgcgagagaaaccattcagatgtgatacatgtggtaagagctttggtctgaaatcagcacttaatagtcatcgcatggtccacacaggagagaaacggtacaaatgtgaggaatgtggaaaacgcttcatttataggcaagatctttataagcatcagatagaccacacaggggagaagccatataattgtaaagaatgtggaaagagcttcagatgggcctcaggtctttcaagacatgtgcgagtccacagtggagagacaacattcaaatgtgaagaatgtgggaagggattttatacaaattcacaacgttattctcaccagagagcgcacagtggagaaaagccatatagatgtgaggagtgtgggaagggctacaaaaggaggttggatcttgactttcatcagagggtccacagaggagagaaaccctataattgtaaggaatgtgggaagagctttggctgggcctcgtgtcttttgaatcatcagagaatccacagtggagaaaaaccatttaaatgtgaagaatgtgggaaaagatttactcagaattcacaactttatacccatcgtagagtccacagtggagaaaaaccattcaaatgtgaagagtgtgggaaaagatttactcagaattcacaactttattctcatcgcagagtccacactggagtaaagccatacaaatgtgaagagtgtgggaagggcttcaacagtaagtttaatcttgacatgcaccagagggtccacaccggagagagaccttataattgtaaagaatgtgggaagagctttagccgggcctcaagtattttgaatcataagagactccatggtgatgaaaagccattcaaatgtgaagagtgtgggaagagatttactgagaattcacagcttcattcccatcagagggttcacactggggaaaagccatacaaatgtgagaagtgtggaaagagcttcagatgggcctcaactcatctaacccatcagagactccacagtagagaaaaactacttcaatgtgaggactgtgggaagagcattgtgcacagttcatgccttaaagaccaacaaagagaccaaagtggagagaaaacatctaaatgtgaggactgtgggaagcgctacaagaggcgcttgaatcttgatacgcttttgtcattatttttaaatgacacataactgttgtactcatttatggggtacagtgtgatagttaatgcaagtatacaatgtgtaatgatcaaatcagtgtaattaacatacctatcacctcaaacatttatcatttatttatgttgggaacccttaaaattcactgtcctagctatttgaaaataatacgttgttaattactgtcaccctgtagtggtgtaaaacactagaacttattcctcctacctgcctgtatttctgtattcattaaccaacctttggctaccaccctgcctcctcacctctaagaactactattctactctctacttctatgaagttaactttttgagcttccacatatgtgtgagaacatgtggtatgtatctttctgtgcctggcatatatcacttaatataatgccctgtaagtctcattcactttgctgtgagtgatagaattttgttgtttttcatggctaaatagtactctgatgtgtatatttgccccattttctttattcattcatccagtggacacttaggttgattacataccttggcctatttcttggctatcgtgaatggtgctgcaataaacatgggggggtggagataacactttaacatactgatttccttttctttggatatgtaccaagtatcatataatagtatgacatgactcaaaattaaggaataagattgtggaaattggttttcaaaaaaaaattctctagtttgaatatagagaaaaattggtgagtgtcttcagctgtcctcatacataatgcatgtgagctcgctttaagcataagtgaaggagtggaaaaatcctggagatagaaatcaaggggtatacatgtggatgtaaaaaatcaacaaagattcttttaagaaaaggtgtgtatgggtagggaacaatagcatgacagcagtgcggcctctaacagtctggaaccagttaggacaaagagcaggattgagcgccattccattcatagacaccgtggtgatattttgagtacattaggttaaaaggctttcttcagcaaaatctatctctagagatagatttgatttttataatcaaatctactagagatagatttgatttttataatcaaatctaccagagatagatttgatttttataatcaaatctactagagatagatttgatttttataatcaaatctactagagatagatttgatttttatacttaatgttctagactgtatcttttcaggatgctaggtactttatgaagatccatgctgtctcaatttgcatagtgggttggaggtccctaagacaatctctccagattctatgatttgctaagaggactcagaatatagttgtactcatgactatattatagtgacaggatacaaataatcagcaaagggaaaaggttcttgtataatatctggagggaatcagatgtaaatttgtaaagatcctttgtgcatggagtaacaggtctcaattcctccagtattgaattgtgactgtacttgtgaaatgtctacaatggaaattaattatcaacccgtaccaaaggttcttattggaactaatcatgtaggtaccatccctctggtacatatcaagattctagactccaagaaggggagcaagtgttcagaataacttgaaccatgcctaccagttatggaatggtggcaaccctctcaaactccgtgtttcctaacaccagctaaaggccagtcttataagcagtcctttctaagatttgcagtctcaggcctgttatattaactttttgtgcacatagtactagaaaactgttggctcagtcttctttttgttttgtgtgttttggtttttaactgtcaccgataccagaatagctcatctccaaggtaactgtaacagaacactcagcagattaaacagaaaatacttgcttattataattattaaaagtttggtagggtctatgtctgctctctggtgtgtcctggatcatcaacttggttacaacatggtgttaacatgtgggactgattgtgtttcttgttaatatttctgtttctcccaaccacgctgaatattaaatacctagttctatatctagta

SEQ ID NO: 201801 - DNA, 552 bp, Homo sapiens
  Payload ID: 19814
  Gene Name: zinc finger protein 225
  ENST ID: ENST00000589155
  CDS Start-End: 186-552
atgcaaataggcttcccagttgattggcccatcttgccagcttcttactgtgcacgtggctgacaaagagaagggaagatggagccgccatctttaacatgattggcacaactgctggcaggattctgctttcccttggactgtatcactcaggactctgaatattccctgaaataggaggaaaaatgaccacgttgaaggaggcagtgaccttcaaggacgtggctgtggtcttcactgaggaagagctgaggctgctggaccttgcccagaggaaactgtaccgagaagtgatgctggagaacttcaggaacctgctctcagtggggcatcaatcactccacagagatactttccacttcctaaaggaagaaaagttttggatgatggagacagcaacccaaagagaagggaatttaggaggcaagatccaaatggagatggagactgtttcagaatcaggaacacatgaaggcttgttcagtcatcaaacctgggaacaaatttcaagtgacttaaccaggtttcaagactccatggtaaacagctttc

SEQ ID NO: 201802 - DNA, 2538 bp, Homo sapiens
  Payload ID: 19814
  Gene Name: zinc finger protein 225
  ENST ID: ENST00000592780
  CDS Start-End: 222-497
ttccgctccgttactgtgaggttgctgcagttttgtccctggtagtttgggtcagttccgcgagacccttctgaatttcctggacctacgcattggatccttaacgaactggtgatcgaattaggggaaaagaaacctcgtcggagagcagaggcaggattctgctttcccttggactgtatcactcaggactctgaatattccctgaaataggaggaaaaatgaccacgttgaaggaggcagtgaccttcaaggacgtggctgtggtcttcactgaggaagagctgaggctgctggaccttgcccagaggaaactgtaccgagaagtgatgctggagaacttcaggaacctgctctcagtggggcatcaatcactccacagagatactttccacttcctaaaggaagaaaagttttggatgatggagacagcaacccaaagagaagggaatttaggtccagcctttcagattcccatcaaaactgaaggtttctgatccttttctatttcaggaggcaagatccaaatggagatggagactgtttcagaatcaggaacacatgaaggcttgttcagtcatcaaacctgggaacaaatttcaagtgacttaaccaggtttcaagactccatggtaaacagctttcagttctccaaacaagatgatatgccctgccaggttgatgcaggactatctataattcacgtaagacagaaaccttctgagggtaggacgtgtaaaaagtcctttagtgatgtctccgtccttgatcttcatcaacaactacagtcaagagagaagtctcatacatgtgatgaatgtggaaagagtttctgttatagctcagctcttcgtattcatcagagagttcacatgggggagaaactctataattgtgatgtgtgtggtaaggaattcaatcagagctcacatctgcaaattcatcagagaatccacactggagagaaaccattcaaatgtgagcagtgtgggaaaggctttagtcgtagatcaggactttatgttcatcgtaaattacacacaggagtgaaacctcatatttgtgagaaatgtgggaaggccttcattcatgattcccagcttcaggaacatcaaagaatccatactggggagaagccattcaaatgtgatatatgttgtaagagcttccgtagtagagcaaatcttaataggcattccatggttcacatgcgagagaaaccattcagatgtgatacatgtggtaagagctttggtctgaaatcagcacttaatagtcatcgcatggtccacacaggagagaaacggtacaaatgtgaggaatgtggaaaacgcttcatttataggcaagatctttataagcatcagatagaccacacaggggagaagccatataattgtaaagaatgtggaaagagcttcagatgggcctcaggtctttcaagacatgtgcgagtccacagtggagagacaacattcaaatgtgaagaatgtgggaagggattttatacaaattcacaacgttattctcaccagagagcgcacagtggagaaaagccatatagatgtgaggagtgtgggaagggctacaaaaggaggttggatcttgactttcatcagagggtccacagaggagagaaaccctataattgtaaggaatgtgggaagagctttggctgggcctcgtgtcttttgaatcatcagagaatccacagtggagaaaaaccatttaaatgtgaagaatgtgggaaaagatttactcagaattcacaactttatacccatcgtagagtccacagtggagaaaaaccattcaaatgtgaagagtgtgggaaaagatttactcagaattcacaactttattctcatcgcagagtccacactggagtaaagccatacaaatgtgaagagtgtgggaagggcttcaacagtaagtttaatcttgacatgcaccagagggtccacaccggagagagaccttataattgtaaagaatgtgggaagagctttagccgggcctcaagtattttgaatcataagagactccatggtgatgaaaagccattcaaatgtgaagagtgtgggaagagatttactgagaattcacagcttcattcccatcagagggttcacactggggaaaagccatacaaatgtgagaagtgtggaaagagcttcagatgggcctcaactcatctaacccatcagagactccacagtagagaaaaactacttcaatgtgaggactgtgggaagagcattgtgcacagttcatgccttaaagaccaacaaagagaccaaagtggagagaaaacatctaaatgtgaggactgtgggaagcgctacaagaggcgcttgaatcttgatacgcttttgtcattatttttaaatgacacataactgttgtactcatttatggggtacagtgtgatagttaatgcaagtatacaatgtgtaatgatcaaatcagtgtaattaacatacctatcacctcaaacatttatcatttatttatgttgggaacccttaaaattcactg

SEQ ID NO: 201803 - DNA, 541 bp, Homo sapiens
  Payload ID: 19814
  Gene Name: zinc finger protein 225
  ENST ID: ENST00000588926
  CDS Start-End: 389-541
acttccgctccgttactgtgaggttgctgcagttttgtccctggtagtttgggtcagttccgcgagacccttctgaatttcctggacctacgcattggatccttaacgaactggtgatcgaattaggggaaaagaaacctcgtcggagagcagaggaaggcgagggttgcatccacttccaggaggggagaggagcatttaacttttatggggcacggcgaccacggtcagagtgtttcacagccttctccttacccagcccgacctttccaaaagagctgcagggagggacttcttggcttctgagggcaaagctctacgcaggattctgctttcccttggactgtatcactcaggactctgaatattccctgaaataggaggaaaaatgaccacgttgaaggaggcagtgaccttcaaggacgtggctgtggtcttcactgaggaagagctgaggctgctggaccttgcccagaggaaactgtaccgagaagtgatgctggagaacttcaggaacctgctctcagtggggcatcaatca

SEQ ID NO: 201804 - DNA, 2404 bp, Homo sapiens
  Payload ID: 19814
  Gene Name: zinc finger protein 225
  Uniprot ID: Q9UK10
  ENST ID: ENST00000590612
  CDS Start-End: 284-2404
taatttccaaataagattccattgtatggataggccacaatttgtctatccatgtacgcataggagggagtttgttggtgtgcagttttgggttactatgaatgatgctgttgggaacattcatgtgttaatttacaatacacattcgtgttggtggatggcatccctggccacactttcatgtctctttttctgccttccctggtactttccaggcaggattctgctttcccttggactgtatcactcaggactctgaatattccctgaaataggaggaaaaatgaccacgttgaaggaggcagtgaccttcaaggacgtggctgtggtcttcactgaggaagagctgaggctgctggaccttgcccagaggaaactgtaccgagaagtgatgctggagaacttcaggaacctgctctcagtggggcatcaatcactccacagagatactttccacttcctaaaggaagaaaagttttggatgatggagacagcaacccaaagagaagggaatttaggaggcaagatccaaatggagatggagactgtttcagaatcaggaacacatgaaggcttgttcagtcatcaaacctgggaacaaatttcaagtgacttaaccaggtttcaagactccatggtaaacagctttcagttctccaaacaagatgatatgccctgccaggttgatgcaggactatctataattcacgtaagacagaaaccttctgagggtaggacgtgtaaaaagtcctttagtgatgtctccgtccttgatcttcatcaacaactacagtcaagagagaagtctcatacatgtgatgaatgtggaaagagtttctgttatagctcagctcttcgtattcatcagagagttcacatgggggagaaactctataattgtgatgtgtgtggtaaggaattcaatcagagctcacatctgcaaattcatcagagaatccacactggagagaaaccattcaaatgtgagcagtgtgggaaaggctttagtcgtagatcaggactttatgttcatcgtaaattacacacaggagtgaaacctcatatttgtgagaaatgtgggaaggccttcattcatgattcccagcttcaggaacatcaaagaatccatactggggagaagccattcaaatgtgatatatgttgtaagagcttccgtagtagagcaaatcttaataggcattccatggttcacatgcgagagaaaccattcagatgtgatacatgtggtaagagctttggtctgaaatcagcacttaatagtcatcgcatggtccacacaggagagaaacggtacaaatgtgaggaatgtggaaaacgcttcatttataggcaagatctttataagcatcagatagaccacacaggggagaagccatataattgtaaagaatgtggaaagagcttcagatgggcctcaggtctttcaagacatgtgcgagtccacagtggagagacaacattcaaatgtgaagaatgtgggaagggattttatacaaattcacaacgttattctcaccagagagcgcacagtggagaaaagccatatagatgtgaggagtgtgggaagggctacaaaaggaggttggatcttgactttcatcagagggtccacagaggagagaaaccctataattgtaaggaatgtgggaagagctttggctgggcctcgtgtcttttgaatcatcagagaatccacagtggagaaaaaccatttaaatgtgaagaatgtgggaaaagatttactcagaattcacaactttatacccatcgtagagtccacagtggagaaaaaccattcaaatgtgaagagtgtgggaaaagatttactcagaattcacaactttattctcatcgcagagtccacactggagtaaagccatacaaatgtgaagagtgtgggaagggcttcaacagtaagtttaatcttgacatgcaccagagggtccacaccggagagagaccttataattgtaaagaatgtgggaagagctttagccgggcctcaagtattttgaatcataagagactccatggtgatgaaaagccattcaaatgtgaagagtgtgggaagagatttactgagaattcacagcttcattcccatcagagggttcacactggggaaaagccatacaaatgtgagaagtgtggaaagagcttcagatgggcctcaactcatctaacccatcagagactccacagtagagaaaaactacttcaatgtgaggactgtgggaagagcattgtgcacagttcatgccttaaagaccaacaaagagaccaaagtggagagaaaacatctaaatgtgaggactgtgggaagcgctacaagaggcgcttgaatcttgatacgcttttgtcattatttttaaatgacacataa

SEQ ID NO: 201805 - DNA, 817 bp, Homo sapiens
  Payload ID: 19815
  Gene Name: zinc finger protein 226
  Uniprot ID: Q9NYT6
  ENST ID: ENST00000300823
  CDS Start-End: 137-421
gacgtagcagccatcttttccctggctttggtgattcagccctgacttctcaaaaagcactgcacagaggaggaggcagcagaaccccatttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttagataccttacttgtaaaagctcttttgctctatgacctggctcaaacttaaacttggatttgaagttagaagaaatgttggaagtcatttatatatgaagaaatgttggaaggactcatatatgcatacattccttgagtgactatgaatgactgccgggcagtaacttctgggctgtggttgtaaactgtgagcactacaaaatgtttttccttattgataccatattatggtaggaaagacatggaataaaaaatttagatagtatgtcagtagttgtgtttttaaatgggtttcattagtgcttagcaattgggagcttggtggaccatctcttggttttggaccatctcttggtttctgtcagtatgtaaaccagaaacttcaaatgtgtcacaaaagatgagcagaactatcccgaggttcattaaagtcttttactctgtc

SEQ ID NO: 201806 - DNA, 2565 bp, Homo sapiens
  Payload ID: 19815
  Gene Name: zinc finger protein 226
  Uniprot ID: Q9NYT6
  ENST ID: ENST00000337433
  CDS Start-End: 145-2556
aggaagacgacgtagcagccatcttttccctggctttggtgattcagccctgacttctcaaaaagcactgcacagaggaggaggcagcagaaccccatttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaaagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtg

SEQ ID NO: 201807 - DNA, 2605 bp, Homo sapiens
  Payload ID: 19815
  Gene Name: zinc finger protein 226
  Uniprot ID: Q9NYT6
  ENST ID: ENST00000454662
  CDS Start-End: 181-2592
caaacttccccgaaatgcacttgtggtcagcagctagcggtcttttgtttggggaaaaaaaggagtagcggctaagagcggagccctgacttctcaaaaagcactgcacagaggaggaggcagcagaaccccatttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaaagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtgaaga

SEQ ID NO: 201808 - DNA, 716 bp, Homo sapiens
  Payload ID: 19815
  Gene Name: zinc finger protein 226
  Uniprot ID: Q9NYT6
  ENST ID: ENST00000413984
  CDS Start-End: 307-591
cgacgtagcagccatcttttccctggctttggtgattcagaaactcccgttctgtggcgaaattctgtgagtccatgaagctggattgtccctgacctcttttgaggaaggagagggttgcttctaactggtcctgggagatgccactgtgatgtatccgggatgaagacacaatcctggttacttcatagcctgtttttcttccccagccctgacttctcaaaaagcactgcacagaggaggaggcagcagaaccccatttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttagataccttacttgtaaaagctcttttgctctatgacctggctcaaacttaaacttggatttgaagttagaagaaatgttggaagtcatttatatatgaagaaatgttggaaggactcatatatgcatacattccttgagtgactatgaatgactgccgggcagtaacttctgggct

SEQ ID NO: 201809 - DNA, 641 bp, Homo sapiens
  Payload ID: 19815
  Gene Name: zinc finger protein 226
  ENST ID: ENST00000588795
  CDS Start-End: 125-394
atcttttccctggctttggtgattcagccctgacttctcaaaaagcactgcacagaggaggaggcagcagaaccccatttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggtaaaaaccaaacagttatgagttcttatagttaactgtccatctgctttgcttcttcttagccttgttgccatcacctggtccaaattgccaactgtctttcctggattattgcaacaccctttgtactgcttgccctgctcccacccctctcctcttacattctgttctttaagtggcaaagtgagtttttgttaccttgtgtcagactatgttgttcttctgctcaaaattctctgtgacttattttacatagagtaaaatccacttaatgtggctgac

SEQ ID NO: 201810 - DNA, 579 bp, Homo sapiens
  Payload ID: 19815
  Gene Name: zinc finger protein 226
  ENST ID: ENST00000585678
  CDS Start-End: 238-579
gtagcagccatcttttccctggctttggtgattcagccctgacttctcaaaaagcactgcacagaggaggaggcagcagaaccccatttcagcttcttaggactctgcacttccccagaaggaagaattaaaaatgaatatgttcaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagta

SEQ ID NO: 201811 - DNA, 2788 bp, Homo sapiens
  Payload ID: 19815
  Gene Name: zinc finger protein 226
  Uniprot ID: Q9NYT6
  ENST ID: ENST00000590089
  CDS Start-End: 368-2779
ggaacctttcaaacttccccgaaatgcacttgtggtcagcagctagcggtcttttgtttggggaaaaaaaggagtagcggctaagagcggagccctgacttctcaaaaagcactgcacagaggaggaggcagcagaaccccatgggctgttttgggagagggactgagtacagtgcaacactactcaaactgtggttcacaaagcagcaacattggcatcacccaggtagaaaggctcattcttgagccctaccgaaggccttctgatttagcatttttgcagataggacccagaaatctgcatttcaacaagatcccaagttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaaagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtg

SEQ ID NO: 201812 - DNA, 5972 bp, Homo sapiens
  Payload ID: 19815
  Gene Name: zinc finger protein 226
  ENST ID: ENST00000588883
  CDS Start-End: 309-578
gacgacgtagcagccatcttttccctggctttggtgattcagaaactcccgttctgtggcgaaattctgtgagtccatgaagctggattgtccctgacctcttttgaggaaggagagggttgcttctaactggtcctgggagatgccactgtgatgtatccgggatgaagacacaatcctggttacttcatagcctgtttttcttccccagccctgacttctcaaaaagcactgcacagaggaggaggcagcagaaccccatttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggtaaaaaccaaacagttatgagttcttatagttaactgtccatctgctttgcttcttcttagccttgttgccatcacctggtccaaattgccaactgtctttcctggattattgcaacaccctttgtactgcttgccctgctcccacccctctcctcttacattctgttctttaagtggcaaagtgagtttttgttaccttgtgtcagactatgttgttcttctgctcaaaattctctgtgacttattttacatagagtaaaatccacttaatgtggctgacagagtcttacacggtgtgcttttcatcccccactacctctctaaatatatcttctatactctctttctgtgaattccagccacattgtcctccctcttgcttttcagacctatcaaggatgcttctgcctcacaaccctgtgtgttcttccctctgcctgaaataatcttttacctataatccttctggtcccttcttcattcatttctttgctcagttttagtattataagaaaggcctcggccgggcacggtggcttgcgcctgtaatcccagcacttcgcgaggctgaggtgggcagatcaatcatgaggtcaggagatcgagaccaacctggctaacacggtgaaaccctgtctctactaaaaatacaaaaaatcagctgggcgtggtggtgggtgcctgtagtcccagctactcggcaggctgaggcagaatggtgtgaacccaggaggcagaggttgcagtgagctgagatcgtgccactgcactccagcctgggcgatagagcgagactgtctcaagaaaaaaaaaaagaaaggcctcctctgaccaccctattaaaaatacattctctccatttactctctgtgcactgccttatattgtgtgtaagcactgattatcacctcatatatgtttttgtttagtgacgtttgtctcctcactggagtgtaatctccaggagtggaggaatgttatctatttgcttctgtctcctcagtgcttagaatagtcctagtatatggcagagacactataaatattagttgaataaatgagttaatggaaatctgtcttccatggaggtaactaataggtggtgaacaaatcagcataaataagggatattgcaaaatattttttgtcttctaatgaattcctaacctaattctaatttctctttgtgtgtgtgtgtgtgtgtgtgtgtgtttgcatgtgtttgcctgtctgtacaagttgacccatatcttggggaacctatagtgtcatagttgtaaccaaactgaataacatgctttgtttatgactttctttgagcatttgtagcagagcatattcattcggggagggaatattttacaataaggacttttatttctatttcttaggtattcccccatagaagggaataaaattcgatttccttatccattatatcaggaaagaaaaagtaaaactaaaaaccaggacatgagcattagcctttccctcaaaatgtttgcacagttgcatcccatttgcttcttccaaagtccacattcataaaaagaaatggatcttacattgttgcctctcaaacatttatatcgtgtaggcttatatgtatgtctttagaaggccttttatgtaatgacaccattactgcttgtgattattctgatatgatactttatctgtttttttttcctaaatatcacaagctattaaatttatttcacaattgactagtagaccactttgtcaatttggaaaacattcttgttaaagacaaacatatctacatccagaaactttctataccttgctttcaaagagacagcattctttgctagccttccaattttgactcagtgcaaaagccttagaaggatccagtgcataggtcttcatgctttcctttcaccccaagtgattatcaactttgatttttctcttcagcaataactcacttggtgtacccctacctcaggtacagcttttcaactttgcagcaaaactgtactttctagttctttttgtatttcagataccttacttgtaaaagctcttttgctctatgacctggctcaaacttaaacttggatttgaagttagaagaaatgttggaagtcatttatatatgaagaaatgttggaaggactcatatatgcatacattccttgagtgactatgaatgactgccgggcagtaacttctgggctgtggttgtaaactgtgagcactacaaaatgtttttccttattgataccatattatggtaggaaagacatggaataaaaaatttagatagtatgtcagtagttgtgtttttaaatgggtttcattagtgcttagcaattgggagcttggtggaccatctcttggttttggaccatctcttggtttctgtcagtatgtaaaccagaaacttcaaatgtgtcacaaaagatgagcagaactatcccgaggttcattaaagtcttttactctgtcctcagtgtgaaatcttaaatctttgaacaaaaaaattcactatctctctgaatcctttgtccttacaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaaagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtgaagactcgtgtcatttgaattcttccagttatcaagtctcaaagtcagtgtttcagccgtagctcctcatgtcccagtggtccaaagacaacaaaacaatctttatgattagcatagcaagggcttctttagtcagaaccttgacctttataaaatgttacttagaagaggggtgttaagagtgaaatttttctcaggccttttataaaagtatcatggtggacatgccaaaattaagtgtccactagaatgttaactccataaagacagaaactttgttcactactgaatctacataatcttaccattgccatatacttcacaggtgctcaatatttgttaataggtcctttttgaaaattatgttgagatcacctgcagaatatcatgaatttgtaaacaggaaacctgaaagtagccttaataagattaagtcgggagaccattgaaatgtagaaaaccactcaatactgaactccccaatgttaatttggcattgtcttgtgattagatcctgtcctcctttagcctcactaatcaagttgggtcctatcttcccagatgtctagttttctactggttttataccatatagattcaattatcttttgtaacagataattgtgttcatcttgtaataactggacactacatactacacttattttttcaacactgttaaggcaggggtttaagtg

SEQ ID NO: 201813 - DNA, 524 bp, Homo sapiens
  Payload ID: 19815
  Gene Name: zinc finger protein 226
  ENST ID: ENST00000586286
  CDS Start-End: 308-524
ggaagacgacgtagcagccatcttttccctggctttggtgattcagaaactcccgttctgtggcgaaattctgtgagtccatgaagctggattgtccctgacctcttttgaggaaggagagggttgcttctaactggtcctgggagatgccactgtgatgtatccgggatgaagacacaatcctggttacttcatagcctgtttttcttccccagccctgacttctcaaaaagcactgcacagaggaggaggcagcagaaccccatcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaaccc

SEQ ID NO: 201814 - DNA, 515 bp, Homo sapiens
  Payload ID: 19815
  Gene Name: zinc finger protein 226
  ENST ID: ENST00000585560
  CDS Start-End: 318-515
gacgacgtagcagccatcttttccctggctttggtgattcagccctgacttctcaaaaagcactgcacagaggaggaggcagcagaaccccatgggctgttttgggagagggactgagtacagtgcaacactactcaaactgtggttcacaaagcagcaacattggcatcacccaggtagaaaggctcattcttgagccctaccgaaggccttctgatttagcatttttgcagataggacccagaaatctgcatttcaacaagatcccaagttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttgg

SEQ ID NO: 201815 - DNA, 576 bp, Homo sapiens
  Payload ID: 19815
  Gene Name: zinc finger protein 226
  ENST ID: ENST00000586914
  CDS Start-End: 309-576
gacgacgtagcagccatcttttccctggctttggtgattcagaaactcccgttctgtggcgaaattctgtgagtccatgaagctggattgtccctgacctcttttgaggaaggagagggttgcttctaactggtcctgggagatgccactgtgatgtatccgggatgaagacacaatcctggttacttcatagcctgtttttcttccccagccctgacttctcaaaaagcactgcacagaggaggaggcagcagaaccccatttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttc

SEQ ID NO: 201816 - DNA, 567 bp, Homo sapiens
  Payload ID: 19815
  Gene Name: zinc finger protein 226
  ENST ID: ENST00000588127
  CDS Start-End: 151-567
atcttttccctggctttggtgattcagaaactcccgttctgtggcgaaattctccctgacttctcaaaaagcactgcacagaggaggaggcagcagaaccccatttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtct

SEQ ID NO: 201817 - DNA, 447 bp, Homo sapiens
  Payload ID: 19815
  Gene Name: zinc finger protein 226
  Uniprot ID: Q9NYT6
  ENST ID: ENST00000588742
  CDS Start-End: 163-447
gacgtagcagccatcttttccctggctttggtgattcagaaactcccgttctgtggcgaaattctccctgacttctcaaaaagcactgcacagaggaggaggcagcagaaccccatttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttagataccttacttgtaaaagctcttttgctctatgacctggctcaaacttaa

SEQ ID NO: 201818 - DNA, 530 bp, Homo sapiens
  Payload ID: 19815
  Gene Name: zinc finger protein 226
  ENST ID: ENST00000590467
  CDS Start-End: 349-530
agccatcttttccctggctttggtgattcagccctgacttctcaaaaagcactgcacagaggaggaggcagcagaaccccatgggctgttttgggagagggactgagtacagtgcaacactactcaaactgtggttcacaaagcagcaacattggcatcacccaggtagaaaggctcattcttgagccctaccgaaggccttctgatttagcatttttgcagataggacccagaaatctgcatttcaacaagatcccaagcttgctgcatccaaggagcccacacatgcatggggtgtcttgttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaag

SEQ ID NO: 201819 - DNA, 656 bp, Homo sapiens
  Payload ID: 19815
  Gene Name: zinc finger protein 226
  ENST ID: ENST00000589160
  CDS Start-End: 183-452
gcacttccgcccaggaagacgacgtagcagccatcttttccctggctttggtgattcagaaactcccgttctgtggcgaaattctccctgacttctcaaaaagcactgcacagaggaggaggcagcagaaccccatttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggtaaaaaccaaacagttatgagttcttatagttaactgtccatctgctttgcttcttcttagccttgttgccatcacctggtccaaattgccaactgtctttcctggattattgcaacaccctttgtactgcttgccctgctcccacccctctcctcttacattctgttctttaagtggcaaagtgagtttttgttaccttgtgtcagactatgttgttcttctgctcaaaattctctg

SEQ ID NO: 201820 - DNA, 616 bp, Homo sapiens
  Payload ID: 19815
  Gene Name: zinc finger protein 226
  ENST ID: ENST00000590524
  CDS Start-End: 158-616
gccctgacttctcaaaaagcactgcacagaggaggaggcagcagaaccccatttgcaaataaataagatacctgactgtgttgtaagagctttctaccttccagcaatccgatgagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagca

SEQ ID NO: 201821 - DNA, 560 bp, Homo sapiens
  Payload ID: 19815
  Gene Name: zinc finger protein 226
  ENST ID: ENST00000586203
  CDS Start-End: 479-560
agcagccatcttttccctggctttggtgattcagaaactcccgttctgtggcgaaattctgtgagtccatgaagctggattgtccctgacctcttttgaggaaggagagggttgcttctaactggtcctgggagatgccactgtgatgtatccgggatgaagacacaatcctggttacttcatagcctgtttttcttccccagccctgacttctcaaaaagcactgcacagaggaggaggcagcagaaccccatgggctgttttgggagagggactgagtacagtgcaacactactcaaactgtggttcacaaagcagcaacattggcatcacccaggtagaaaggctcattcttgagccctaccgaaggccttctgatttagcatttttgcagataggacccagaaatctgcatttcaacaagatcccaagttcagcttcttaggactctgcacttccccagaaggaagaattaaaaatgaatatgttcaaggaagcagtgaccttcaaggacgtggctgtggccttcacggaggaggaattggggctgctgggccctg

SEQ ID NO: 201822 - DNA, 548 bp, Homo sapiens
  Payload ID: 19815
  Gene Name: zinc finger protein 226
  ENST ID: ENST00000590578
  CDS Start-End: 168-548
gatactcgcaggcacttccgcccaggaagacgacgtagcagccatcttttccctggctttggtgattcagccctgacttctcaaaaagcactgcacagaggaggaggcagcagaaccccatttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaa

SEQ ID NO: 201823 - DNA, 3043 bp, Homo sapiens
  Payload ID: 19816
  Gene Name: zinc finger protein 227
  Uniprot ID: Q86WZ6
  ENST ID: ENST00000313040
  CDS Start-End: 206-2605
acttccgccccggaaagcgaggccgccaccatcttttgggtccgggaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccagttatgccatctcagaactatgaccttccccagaagaagcaggagaaaatgaccaagtttcaggaggctgtgacattcaaggatgtggctgtggtcttctccagggaggaactgcgactgctcgatcttacccagaggaagctgtaccgagatgtcatggtggagaacttcaagaacctggttgcagtggggcatcttcccttccaaccagatatggtatcccaattggaagcagaagaaaagctttggatgatggaaacagaaacccaaagaagcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccagttattacaaggtgactctattcaggtttctgaaaatgagaacaatataatgaaccctaaaggagatagctctatttatattgaaaatcaagagtttccattttggagaacccagcattcttgcgggaatacatatctgagtgagtcacagattcagagtagaggtaagcaaattgatgtgaaaaataacctgcaaatacatgaagacttcatgaagaaatcaccatttcatgagcatattaaaactgacacagaaccaaaaccctgcaaaggtaatgaatatggcaaaatcattagtgatggctccaatcagaaattacccttaggagagaaaccccatccatgtggtgagtgtggaaggggcttcagttatagcccaaggcttccccttcatccgaatgttcatacaggagaaaaatgcttcagtcaaagctcacatctgcgaactcatcagagaattcacccaggagagaaactcaatagatgtcatgaatctggtgattgcttcaataagagctcttttcattcttatcaatctaatcatacaggagagaagtcttatagatgcgacagttgcggcaagggattcagtagcagcacgggtcttatcattcattacagaactcatactggagagaaaccctataaatgcgaggaatgtggtaaatgctttagtcaaagttcaaattttcagtgccatcagagagtccacactgaagaaaaaccatacaaatgcgaagagtgtggtaagggcttcggttggagtgttaatctccgtgttcaccagagggtccacaggggtgagaagccctataaatgtgaggaatgtggtaagggcttcactcaggctgcacattttcacatccatcagagagtccacactggagagaaaccctacaagtgtgatgtgtgtggtaagggcttcagccacaattcaccattaatatgccatcggagagtccacacaggagagaagccatacaagtgtgaggcgtgtgggaaaggctttacccgtaatacagatctgcatattcatttcagagttcacacgggagagaaaccctataaatgtaaggagtgtggtaagggcttcagtcaggcttcaaatcttcaagtccatcagaatgtccacactggggagaaacgattcaagtgtgaaacgtgtgggaagggcttcagtcagtcctcaaagcttcaaacccatcagcgagtccacactggagagaaaccatatagatgtgatgtgtgtggtaaggacttcagttatagttcaaatcttaaactacaccaagtaattcacactggagaaaaaccatataaatgtgaggaatgtgggaagggcttcagttggagatcaaatcttcatgcacatcaaagagttcactcaggagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagagtccacacgggggaaaagccatacaaatgtgatgtgtgtggaaagggctttagatacagttcgcagtttatataccatcagagaggccacactggagaaaaaccttacaaatgtgaagagtgtgggaaaggctttggtaggagcttgaatcttcgccatcatcagagggtccacacgggagagaaaccccatatatgtgaggagtgtggtaaggccttcagtctcccctcaaatcttcgagtccacctgggtgttcacaccagggaaaaactctttaaatgtgaagagtgtggtaaaggcttcagtcagagtgcacgtcttgaagcccatcagagagtccacactggagaaaaaccatacaaatgtgacatatgtgataaggacttccgtcaccgttcacgtcttacatatcatcagaaagtccatactggtaaaaagctttagaaatgagaaatgtgttaccaacttttgtctgaatgcacatcttcaagtttttggctagtccatgctggtggtaaaccctgtaaaactactgagagtggaagggggtttgttcacacttggaatctttctaacaaatccatcaagatgataacacagaaccatgaacaggaatagaactcgtatttaggggagaaatagggctggtggctctcttggtaagatctagttaatataaatgatcacctttcattgtgaatatatgcctgaagataatgtgtggaaggatatttgccatatgctaactggttttttggccagggagagttttgggttattatcccttttctttaattttcattttatacttacagtgatcattattttcataaaagctgtaaagctatgaaaaatgaataaaattactaaaaattttctgta

SEQ ID NO: 201824 - DNA, 2993 bp, Homo sapiens
  Payload ID: 19816
  Gene Name: zinc finger protein 227
  Uniprot ID: Q86WZ6
  ENST ID: ENST00000391961
  CDS Start-End: 310-2556
aggcagagccacttccgccccggaaagcgaggccgccaccatcttttgggtccgggagaaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccaggaggctgtgacattcaaggatgtggctgtggtcttctccagggaggaactgcgactgctcgatcttacccagaggaagctgtaccgagatgtcatggtggagaacttcaagaacctggttgcagtggggcatcttcccttccaaccagatatggtatcccaattggaagcagaagaaaagctttggatgatggaaacagaaacccaaagaagcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccagttattacaaggtgactctattcaggtttctgaaaatgagaacaatataatgaaccctaaaggagatagctctatttatattgaaaatcaagagtttccattttggagaacccagcattcttgcgggaatacatatctgagtgagtcacagattcagagtagaggtaagcaaattgatgtgaaaaataacctgcaaatacatgaagacttcatgaagaaatcaccatttcatgagcatattaaaactgacacagaaccaaaaccctgcaaaggtaatgaatatggcaaaatcattagtgatggctccaatcagaaattacccttaggagagaaaccccatccatgtggtgagtgtggaaggggcttcagttatagcccaaggcttccccttcatccgaatgttcatacaggagaaaaatgcttcagtcaaagctcacatctgcgaactcatcagagaattcacccaggagagaaactcaatagatgtcatgaatctggtgattgcttcaataagagctcttttcattcttatcaatctaatcatacaggagagaagtcttatagatgcgacagttgcggcaagggattcagtagcagcacgggtcttatcattcattacagaactcatactggagagaaaccctataaatgcgaggaatgtggtaaatgctttagtcaaagttcaaattttcagtgccatcagagagtccacactgaagaaaaaccatacaaatgcgaagagtgtggtaagggcttcggttggagtgttaatctccgtgttcaccagagggtccacaggggtgagaagccctataaatgtgaggaatgtggtaagggcttcactcaggctgcacattttcacatccatcagagagtccacactggagagaaaccctacaagtgtgatgtgtgtggtaagggcttcagccacaattcaccattaatatgccatcggagagtccacacaggagagaagccatacaagtgtgaggcgtgtgggaaaggctttacccgtaatacagatctgcatattcatttcagagttcacacgggagagaaaccctataaatgtaaggagtgtggtaagggcttcagtcaggcttcaaatcttcaagtccatcagaatgtccacactggggagaaacgattcaagtgtgaaacgtgtgggaagggcttcagtcagtcctcaaagcttcaaacccatcagcgagtccacactggagagaaaccatatagatgtgatgtgtgtggtaaggacttcagttatagttcaaatcttaaactacaccaagtaattcacactggagaaaaaccatataaatgtgaggaatgtgggaagggcttcagttggagatcaaatcttcatgcacatcaaagagttcactcaggagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagagtccacacgggggaaaagccatacaaatgtgatgtgtgtggaaagggctttagatacagttcgcagtttatataccatcagagaggccacactggagaaaaaccttacaaatgtgaagagtgtgggaaaggctttggtaggagcttgaatcttcgccatcatcagagggtccacacgggagagaaaccccatatatgtgaggagtgtggtaaggccttcagtctcccctcaaatcttcgagtccacctgggtgttcacaccagggaaaaactctttaaatgtgaagagtgtggtaaaggcttcagtcagagtgcacgtcttgaagcccatcagagagtccacactggagaaaaaccatacaaatgtgacatatgtgataaggacttccgtcaccgttcacgtcttacatatcatcagaaagtccatactggtaaaaagctttagaaatgagaaatgtgttaccaacttttgtctgaatgcacatcttcaagtttttggctagtccatgctggtggtaaaccctgtaaaactactgagagtggaagggggtttgttcacacttggaatctttctaacaaatccatcaagatgataacacagaaccatgaacaggaatagaactcgtatttaggggagaaatagggctggtggctctcttggtaagatctagttaatataaatgatcacctttcattgtgaatatatgcctgaagataatgtgtggaaggatatttgccatatgctaactggttttttggccagggagagttttgggttattatcccttttctttaattttcattttatacttacagtgatcattattttcataaaagctgtaaagctatgaaaaatgaataaaattactaaaaattttctgt

SEQ ID NO: 201825 - DNA, 545 bp, Homo sapiens
  Payload ID: 19816
  Gene Name: zinc finger protein 227
  ENST ID: ENST00000586048
  CDS Start-End: 299-545
cttttcagcctgtgcttgggaataggcgctccccagccatcagtcttgggatggagaggtcgcggccgcggcggaggccgagaggccgagggcgggaagtttgctctcctcccgcacttggcaagcagcgccgctagttctgattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccagttatgccatctcagaactatgaccttccccagaagaagcaggagaaaatgaccaagtttcaggaggctgtgacattcaaggatgtggctgtggtcttctccagggaggaactgcgactgctcgatcttacccagaggaagctgtaccgagatgtcatggtggagaacttcaagaacctggttgcagtggggcatcttcccttccaaccagatatggtatcccaattggaagcagaagaaaagctttgga

SEQ ID NO: 201826 - DNA, 584 bp, Homo sapiens
  Payload ID: 19816
  Gene Name: zinc finger protein 227
  ENST ID: ENST00000588219
  CDS Start-End: 297-584
acttccgccccggaaagcgaggccgccaccatcttttgggtccgggaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccaggaggctgtgacattcaaggatgtggctgtggtcttctccagggaggaactgcgactgctcgatcttacccagaggaagctgtaccgagatgtcatggtggagaacttcaagaacctggttgcagtgggcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccagttattacaaggtgactctattcaggtttctgaaaatgagaacaatataatgaaccctaaaggagatagctctatttatattgaaaatcaagagtttccattttggagaacccag

SEQ ID NO: 201827 - DNA, 504 bp, Homo sapiens
  Payload ID: 19816
  Gene Name: zinc finger protein 227
  ENST ID: ENST00000589707
  CDS Start-End: 270-383
accatcttttgggtccgggaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccaggaggctgtgacattcaaggatgtggctgtggtcttctccagggaggaactgcgactgctcgatcttacccagaggaagctgtaccgagatgtcatggtggagaacttcaagaacctggttgcagtgggtgaggacaggcactctctgaccctgaacttcagttcccttgagaatctctttgctctcaggcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccag

SEQ ID NO: 201828 - DNA, 838 bp, Homo sapiens
  Payload ID: 19816
  Gene Name: zinc finger protein 227
  ENST ID: ENST00000588394
  CDS Start-End: 194-838
ttttgggtccgggagatcttttttttttttaagaaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccagttatgccatctcagaactatgaccttccccagaagaagcaggagaaaatgaccaagtttcaggaggctgtgacattcaaggatgtggctgtggtcttctccagggaggaactgcgactgctcgatcttacccagaggaagctgtaccgagatgtcatggtggagaacttcaagaacctggttgcagtgggcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccagttattacaaggtgactctattcaggtttctgaaaatgagaacaatataatgaaccctaaaggagatagctctatttatattgaaaatcaagagtttccattttggagaacccagcattcttgcgggaatacatatctgagtgagtcacagattcagagtagaggtaagcaaattgatgtgaaaaataacctgcaaatacatgaagacttcatgaagaaatcaccatttcatgagcatattaaaactgacacagaaccaaaaccctgcaaaggtaatgaatatggcaaaatcattagtgatggctccaatcagaaatta

SEQ ID NO: 201829 - DNA, 569 bp, Homo sapiens
  Payload ID: 19816
  Gene Name: zinc finger protein 227
  ENST ID: ENST00000586228
  CDS Start-End: 206-454
acttccgccccggaaagcgaggccgccaccatcttttgggtccgggaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccagttatgccatctcagaactatgaccttccccagaagaagcaggagaaaatgaccaagtttcagggaggaactgcgactgctcgatcttacccagaggaagctgtaccgagatgtcatggtggagaacttcaagaacctggttgcagtggggcatcttcccttccaaccagatatggtatcccaattggaagcagaagaaaagctttggatgatggaaacagaaacccaaagaagcagcaagcatcaaaataagatggaaacactccaaaaatttgcattaaaatacctttcaaatcaagagctgtcctgctggcaaatctggaaacaggttgcaagtgaattaaccaggtgtcttcaggggaagagt

SEQ ID NO: 201830 - DNA, 2943 bp, Homo sapiens
  Payload ID: 19816
  Gene Name: zinc finger protein 227
  Uniprot ID: Q86WZ6
  ENST ID: ENST00000589005
  CDS Start-End: 260-2506
gggtccgggaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccaggaggctgtgacattcaaggatgtggctgtggtcttctccagggaggaactgcgactgctcgatcttacccagaggaagctgtaccgagatgtcatggtggagaacttcaagaacctggttgcagtggggcatcttcccttccaaccagatatggtatcccaattggaagcagaagaaaagctttggatgatggaaacagaaacccaaagaagcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccagttattacaaggtgactctattcaggtttctgaaaatgagaacaatataatgaaccctaaaggagatagctctatttatattgaaaatcaagagtttccattttggagaacccagcattcttgcgggaatacatatctgagtgagtcacagattcagagtagaggtaagcaaattgatgtgaaaaataacctgcaaatacatgaagacttcatgaagaaatcaccatttcatgagcatattaaaactgacacagaaccaaaaccctgcaaaggtaatgaatatggcaaaatcattagtgatggctccaatcagaaattacccttaggagagaaaccccatccatgtggtgagtgtggaaggggcttcagttatagcccaaggcttccccttcatccgaatgttcatacaggagaaaaatgcttcagtcaaagctcacatctgcgaactcatcagagaattcacccaggagagaaactcaatagatgtcatgaatctggtgattgcttcaataagagctcttttcattcttatcaatctaatcatacaggagagaagtcttatagatgcgacagttgcggcaagggattcagtagcagcacgggtcttatcattcattacagaactcatactggagagaaaccctataaatgcgaggaatgtggtaaatgctttagtcaaagttcaaattttcagtgccatcagagagtccacactgaagaaaaaccatacaaatgcgaagagtgtggtaagggcttcggttggagtgttaatctccgtgttcaccagagggtccacaggggtgagaagccctataaatgtgaggaatgtggtaagggcttcactcaggctgcacattttcacatccatcagagagtccacactggagagaaaccctacaagtgtgatgtgtgtggtaagggcttcagccacaattcaccattaatatgccatcggagagtccacacaggagagaagccatacaagtgtgaggcgtgtgggaaaggctttacccgtaatacagatctgcatattcatttcagagttcacacgggagagaaaccctataaatgtaaggagtgtggtaagggcttcagtcaggcttcaaatcttcaagtccatcagaatgtccacactggggagaaacgattcaagtgtgaaacgtgtgggaagggcttcagtcagtcctcaaagcttcaaacccatcagcgagtccacactggagagaaaccatatagatgtgatgtgtgtggtaaggacttcagttatagttcaaatcttaaactacaccaagtaattcacactggagaaaaaccatataaatgtgaggaatgtgggaagggcttcagttggagatcaaatcttcatgcacatcaaagagttcactcaggagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagagtccacacgggggaaaagccatacaaatgtgatgtgtgtggaaagggctttagatacagttcgcagtttatataccatcagagaggccacactggagaaaaaccttacaaatgtgaagagtgtgggaaaggctttggtaggagcttgaatcttcgccatcatcagagggtccacacgggagagaaaccccatatatgtgaggagtgtggtaaggccttcagtctcccctcaaatcttcgagtccacctgggtgttcacaccagggaaaaactctttaaatgtgaagagtgtggtaaaggcttcagtcagagtgcacgtcttgaagcccatcagagagtccacactggagaaaaaccatacaaatgtgacatatgtgataaggacttccgtcaccgttcacgtcttacatatcatcagaaagtccatactggtaaaaagctttagaaatgagaaatgtgttaccaacttttgtctgaatgcacatcttcaagtttttggctagtccatgctggtggtaaaccctgtaaaactactgagagtggaagggggtttgttcacacttggaatctttctaacaaatccatcaagatgataacacagaaccatgaacaggaatagaactcgtatttaggggagaaatagggctggtggctctcttggtaagatctagttaatataaatgatcacctttcattgtgaatatatgcctgaagataatgtgtggaaggatatttgccatatgctaactggttttttggccagggagagttttgggttattatcccttttctttaattttcattttatacttacagtgatcattattttcataaaagctgtaaagctatgaaaaatgaataaaattactaaaaattttctgt

SEQ ID NO: 201831 - DNA, 3055 bp, Homo sapiens
  Payload ID: 19816
  Gene Name: zinc finger protein 227
  Uniprot ID: Q86WZ6
  ENST ID: ENST00000621083
  CDS Start-End: 219-2618
aggcagagccacttccgccccggaaagcgaggccgccaccatcttttgggtccgggagaaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccagttatgccatctcagaactatgaccttccccagaagaagcaggagaaaatgaccaagtttcaggaggctgtgacattcaaggatgtggctgtggtcttctccagggaggaactgcgactgctcgatcttacccagaggaagctgtaccgagatgtcatggtggagaacttcaagaacctggttgcagtggggcatcttcccttccaaccagatatggtatcccaattggaagcagaagaaaagctttggatgatggaaacagaaacccaaagaagcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccagttattacaaggtgactctattcaggtttctgaaaatgagaacaatataatgaaccctaaaggagatagctctatttatattgaaaatcaagagtttccattttggagaacccagcattcttgcgggaatacatatctgagtgagtcacagattcagagtagaggtaagcaaattgatgtgaaaaataacctgcaaatacatgaagacttcatgaagaaatcaccatttcatgagcatattaaaactgacacagaaccaaaaccctgcaaaggtaatgaatatggcaaaatcattagtgatggctccaatcagaaattacccttaggagagaaaccccatccatgtggtgagtgtggaaggggcttcagttatagcccaaggcttccccttcatccgaatgttcatacaggagaaaaatgcttcagtcaaagctcacatctgcgaactcatcagagaattcacccaggagagaaactcaatagatgtcatgaatctggtgattgcttcaataagagctcttttcattcttatcaatctaatcatacaggagagaagtcttatagatgcgacagttgcggcaagggattcagtagcagcacgggtcttatcattcattacagaactcatactggagagaaaccctataaatgcgaggaatgtggtaaatgctttagtcaaagttcaaattttcagtgccatcagagagtccacactgaagaaaaaccatacaaatgcgaagagtgtggtaagggcttcggttggagtgttaatctccgtgttcaccagagggtccacaggggtgagaagccctataaatgtgaggaatgtggtaagggcttcactcaggctgcacattttcacatccatcagagagtccacactggagagaaaccctacaagtgtgatgtgtgtggtaagggcttcagccacaattcaccattaatatgccatcggagagtccacacaggagagaagccatacaagtgtgaggcgtgtgggaaaggctttacccgtaatacagatctgcatattcatttcagagttcacacgggagagaaaccctataaatgtaaggagtgtggtaagggcttcagtcaggcttcaaatcttcaagtccatcagaatgtccacactggggagaaacgattcaagtgtgaaacgtgtgggaagggcttcagtcagtcctcaaagcttcaaacccatcagcgagtccacactggagagaaaccatatagatgtgatgtgtgtggtaaggacttcagttatagttcaaatcttaaactacaccaagtaattcacactggagaaaaaccatataaatgtgaggaatgtgggaagggcttcagttggagatcaaatcttcatgcacatcaaagagttcactcaggagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagagtccacacgggggaaaagccatacaaatgtgatgtgtgtggaaagggctttagatacagttcgcagtttatataccatcagagaggccacactggagaaaaaccttacaaatgtgaagagtgtgggaaaggctttggtaggagcttgaatcttcgccatcatcagagggtccacacgggagagaaaccccatatatgtgaggagtgtggtaaggccttcagtctcccctcaaatcttcgagtccacctgggtgttcacaccagggaaaaactctttaaatgtgaagagtgtggtaaaggcttcagtcagagtgcacgtcttgaagcccatcagagagtccacactggagaaaaaccatacaaatgtgacatatgtgataaggacttccgtcaccgttcacgtcttacatatcatcagaaagtccatactggtaaaaagctttagaaatgagaaatgtgttaccaacttttgtctgaatgcacatcttcaagtttttggctagtccatgctggtggtaaaccctgtaaaactactgagagtggaagggggtttgttcacacttggaatctttctaacaaatccatcaagatgataacacagaaccatgaacaggaatagaactcgtatttaggggagaaatagggctggtggctctcttggtaagatctagttaatataaatgatcacctttcattgtgaatatatgcctgaagataatgtgtggaaggatatttgccatatgctaactggttttttggccagggagagttttgggttattatcccttttctttaattttcattttatacttacagtgatcattattttcataaaagctgtaaagctatgaaaaatgaataaaattactaaaaattttctgt

SEQ ID NO: 201832 - DNA, 525 bp, Homo sapiens
  Payload ID: 19817
  Gene Name: zinc finger protein 229
  ENST ID: ENST00000592308
  CDS Start-End: 489-525
ttcttaggcagtggtgaggcgtcttagagacgtgcatctccatgcggttgtactgtcaggccatgggaattaggatcggctctataggaccagtgtgaagggacaacgtgcggcggagggtcgaagcccacggatttccatgagctcggcctggcttccttcttggaattgttcgtttctcggagataattgtataaaagaaggagaaataaccccacatctcttgacactagagctccaggtcccctgaccatgggaagcagtcgcgctctggacagtaaaggtggagacaggaacttgtcagagcttggagagtttccggaatgaaaaaggcctggatcttctgcgtctccagcttaggaaaaccagagaataaatacagttgctgctgctcgcagagaacctagcagaagagaccatggagactttgacctcaagctcttcattctcaagcctcagccatttcccaagatagggaggagaagatcatgtctcaggagccattgagcttcaaggacgtggctg

SEQ ID NO: 201833 - DNA, 4835 bp, Homo sapiens
  Payload ID: 19817
  Gene Name: zinc finger protein 229
  ENST ID: ENST00000613197
  CDS Start-End: 324-2783
gcatttacgacaccatcgcccctaggatcggactgcgctgcggagggttctgggaaaggcttccttcttggaattgttcgtttctcggagataattgtataaaagaaggagaaataaccccacatctcttgacactagagctccaggtcccctgaccatgggaagcagtcgcgctctggacagtaaaggtggagacaggaacttgtcagagcttggagagtttccggaatgaaaaaggcctggatcttctgcgtctccagcttaggaaaaccagagaataaatacagttgctgctgctcgcagagaacctagcagaagagaccatggagactttgacctcaaggcatgagaaaagagctcttcattctcaagcctcagccatttcccaagatagggaggagaagatcatgtctcaggagccattgagcttcaaggacgtggctgtggtcttcactgaggaggagctagagctgctggactctacccagaggcagctgtaccaagatgtgatgcaggagaatttcaggaacctactctcagtgggagacaagaatggaaaggatacggagtatattcaagatgaagaattaaggttcttttcacacaaagagctctcctcatgcaaaatctgggaagaggtggcaggtgaattacctgggagccaagactgtagagtaaatctgcaaggaaaagacttccagttctcagaagatgctgctccccatcaagggtgggaaggagcatctacgccgtgttttccaattgagaatttcctggacagtctacaaggggatgggcttatcggtctagaaaatcaacagtttccagcctggagagctataagaccaatccccattcaaggatcttgggcaaaagcgtttgtgaaccagttaggggatgttcaagaaagatgtaaaaatctcgacacagaagacacagtatataaatgtaactgggatgatgacagcttttgctggatatcttgtcatgttgatcacagattccctgaaatagacaagccgtgtggttgcaataaatgcagaaaagactgcattaaaaactctgtacttcatcgcattaaccctggagagaatggcttgaaaagtaacgaatacagaaatggcttcagggacgatgcagaccttcccccgcatccaagagtacctttgaaagagaaactctgtcaatatgatgagtttagtgagggcttgaggcacagtgcccatcttaacagacatcaaagagttcccacaggagagaaatctgttaagagtcttgagcgtggtcggggcgtcagacagaacacgcacatacgtaaccaccccagagcccctgtgggagacatgccctatagatgtgatgtctgtggaaaggggttcaggtataaatcggttcttcttattcatcaaggggtgcacacaggaaggagaccctataaatgtgaggagtgtgggaaggcatttggtcgaagttcaaacctgcttgtccatcagagggtccacactggagagaaaccatataaatgcagcgagtgtgggaagggcttcagttacagctcagtgcttcaagtccatcagaggctgcacacaggggagaagccctacacctgcagcgagtgtggcaaaggcttctgtgccaagtctgcactgcacaaacaccagcacattcaccctggagaaaagccctacagctgtggcgagtgtggaaagggattcagctgcagctcccacctcagcagtcatcagaagacacacaccggcgagaggccctaccagtgtgacaagtgtggcaaaggtttcagtcacaactcgtaccttcaagctcaccagagagttcacatggggcagcatctgtacaaatgtaacgtgtgtggtaagagtttcagttacagctcagggcttctcatgcatcagagactgcacacaggagagaaaccctacaaatgcgagtgcgggaagagctttggccggagctccgacctccacatccatcagagggtccacacaggagagaaaccctataaatgcagtgagtgtgggaagggcttccggcggaattcagaccttcacagccaccagagggtccacacgggagagaggccctacgtgtgtgacgtgtgtgggaagggtttcatctacagctccgacctccttatccatcagagggtccacactggagagaaaccctataaatgtgctgagtgtggcaaaggcttcagttacagctcagggcttctcattcaccagagagtccacacaggcgagaaaccttacagatgccaagagtgcggaaagggctttaggtgcacatcaagccttcacaaacatcagcgagtccacacgggaaaaaagccctatacgtgtgatcagtgtggcaagggattcagttatggctctaatcttcgcacccaccagaggttgcacacaggagagaaaccctacacttgttgtgaatgtgggaagggtttcagatatggctcaggtctccttagtcataagagagtgcacactggcgagaagccatacagatgccacgtgtgtgggaagggctatagtcagagctcacatcttcaaggtcatcagagggtccacactggtgagaaaccctataaatgtgaggagtgtgggaagggctttggccgcaactcctgtcttcatgttcatcagagagtccacactggagagaagccctatacgtgtggtgtgtgtgggaaaggcttcagttatacctcaggtctgcggaaccaccaaagagtgcatttaggcgagaacccttataagtagatgtacatagaggattccatctgggactcagagctttctatccatctgagagccaacacaggagaaaaaccataggaaagtgacatgtaggagggctataggagaaactgatgattttacattttctagtctgcataggaagggaacacctggatgtgtgataaataggttagcacttcagttacaaacttcagtctttaagagtctgttgtgcagcggagtaggctttaaagaaacagtgcagcagtggtttcagtaataatcctcacttccatcagaatctgcctgggagggagcttttacaatgtacaagtggtgagaatgtttccaaggtgctaattatggacatagattctttgtgtgggttgatagctaccaatgggacagtgtagaaacaagtttccacctttctaaaaccagtttggtacatatctttttaaagatcgctttataaaaacaaaaagataacattaacatttattgaaacaagtcactctgagaagaccaggaacaaagttctcttggcagatctgggtgatgtgtgtgtctcacatttttatcatgtttttatgactgttttatcttgcaggtaagctttacagctttcagaggagttgtagtacactacagaaatatgtcttctttccaggttcaaaaagcaaaatctgattggcattgcattgaattattaattaaataaatttattaattggcattgcattgaatttataggttaattttgaaagaatgtggcgtctttgaaatgctgattttttttcactttaaaaaaatgactttttttttaccactgatagtatttcatatggtccctcagtaatatttcttagagatggttaaaaataggttctgagtcatcttaagcatatttctaggaatttgttttattgctgtcatgaatataatggttttgctccagttcatttcatagtttaacatatcaaatattaggtatcttaaaaatcacaaatgctatttcaccctgcaggttagcagtattaaaatagaatcatcaaatcccccatcagtgggggcgggggggggggttgtagaaacagtctgatatggtttggctcttgtccccacccaaatctcatctcaattttaatccccacgtgtcagaggagggccttggtgggagatgattggatcacgagggcagatttctcccttgctgttctcatgatagtgagttctcatgagagctgatggttttaaggtgtagcccttcctcgctgtctctctcctgtccccttgtgaagaaggtccttatttctcttttgcgttctgccatgactaagttttcggaggcctccccagccatgtggaactgtgtgtgagttaaacctctttcctttgcaaattacctagtctcaggtagttctttatagcagtgcaaaaatggacgtaataagtcttatgtacttattggtgagagagaaaatccgtgcattgttttcaaaagaattcattaacgtatcaattcaatttctataacctttgaagtggcagtaaatatgtagtaattgatacttgggagatagttgcccacttgggcaaaaacgcatgcagaaggtggagtttttaaatttaaaacatttttaaaatagcaaatgttaatattccagtttccattggtaggaaattttttagataagttcaggcatatgtatgcaatggaaagccactagaaatcttcaggcacacagataatgacaatgcaggttgctcatgaagtatttagtgaaccaggagagttttagaacaacaattatagcatgaccccattttgttagtatgtttttctgtgtgtatgtttagagcaacagagaaaaaaagatgtgggagaggacatataactacttatctctagtggtgggattctgaatgtataatacatatgttgtacttttatgtattttactttgtaacaaagtatctttcagttttataataacagtagagctattttttataaattagcctgatggaacaatcccttatgattaaagattcatgttgtaacctctataa

SEQ ID NO: 201834 - DNA, 4507 bp, Homo sapiens
  Payload ID: 19817
  Gene Name: zinc finger protein 229
  Uniprot ID: Q9UJW7
  ENST ID: ENST00000614049
  CDS Start-End: 435-2912
gcgtcaccttgattgcttcttaggcagtggtgaggcgtcttagagacgtgcatctccatgcggttgtactgtcaggccatgggaattaggatcggctctataggaccagtgtgaagggacaacgtgcggcggagggtcgaagcccacggatttccatgagctcggcctggcttccttcttggaattgttcgtttctcggagataattgtataaaagaaggagaaataaccccacatctcttgacactagagctccaggtcccctgaccatgggaagcagtcgcgctctggacagtaaaggtggagacaggaacttgtcagagcttggagagtttccggaatgaaaaaggcctggatcttctgcgtctccagcttaggaaaaccagagaataaatacagttgctgctgctcgcagagaacctagcagaagagaccatggagactttgacctcaaggcatgagaaaagagctcttcattctcaagcctcagccatttcccaagatagggaggagaagatcatgtctcaggagccattgagcttcaaggacgtggctgtggtcttcactgaggaggagctagagctgctggactctacccagaggcagctgtaccaagatgtgatgcaggagaatttcaggaacctactctcagtgggtgagaggaatcctctgggagacaagaatggaaaggatacggagtatattcaagatgaagaattaaggttcttttcacacaaagagctctcctcatgcaaaatctgggaagaggtggcaggtgaattacctgggagccaagactgtagagtaaatctgcaaggaaaagacttccagttctcagaagatgctgctccccatcaagggtgggaaggagcatctacgccgtgttttccaattgagaatttcctggacagtctacaaggggatgggcttatcggtctagaaaatcaacagtttccagcctggagagctataagaccaatccccattcaaggatcttgggcaaaagcgtttgtgaaccagttaggggatgttcaagaaagatgtaaaaatctcgacacagaagacacagtatataaatgtaactgggatgatgacagcttttgctggatatcttgtcatgttgatcacagattccctgaaatagacaagccgtgtggttgcaataaatgcagaaaagactgcattaaaaactctgtacttcatcgcattaaccctggagagaatggcttgaaaagtaacgaatacagaaatggcttcagggacgatgcagaccttcccccgcatccaagagtacctttgaaagagaaactctgtcaatatgatgagtttagtgagggcttgaggcacagtgcccatcttaacagacatcaaagagttcccacaggagagaaatctgttaagagtcttgagcgtggtcggggcgtcagacagaacacgcacatacgtaaccaccccagagcccctgtgggagacatgccctatagatgtgatgtctgtggaaaggggttcaggtataaatcggttcttcttattcatcaaggggtgcacacaggaaggagaccctataaatgtgaggagtgtgggaaggcatttggtcgaagttcaaacctgcttgtccatcagagggtccacactggagagaaaccatataaatgcagcgagtgtgggaagggcttcagttacagctcagtgcttcaagtccatcagaggctgcacacaggggagaagccctacacctgcagcgagtgtggcaaaggcttctgtgccaagtctgcactgcacaaacaccagcacattcaccctggagaaaagccctacagctgtggcgagtgtggaaagggattcagctgcagctcccacctcagcagtcatcagaagacacacaccggcgagaggccctaccagtgtgacaagtgtggcaaaggtttcagtcacaactcgtaccttcaagctcaccagagagttcacatggggcagcatctgtacaaatgtaacgtgtgtggtaagagtttcagttacagctcagggcttctcatgcatcagagactgcacacaggagagaaaccctacaaatgcgagtgcgggaagagctttggccggagctccgacctccacatccatcagagggtccacacaggagagaaaccctataaatgcagtgagtgtgggaagggcttccggcggaattcagaccttcacagccaccagagggtccacacgggagagaggccctacgtgtgtgacgtgtgtgggaagggtttcatctacagctccgacctccttatccatcagagggtccacactggagagaaaccctataaatgtgctgagtgtggcaaaggcttcagttacagctcagggcttctcattcaccagagagtccacacaggcgagaaaccttacagatgccaagagtgcggaaagggctttaggtgcacatcaagccttcacaaacatcagcgagtccacacgggaaaaaagccctatacgtgtgatcagtgtggcaagggattcagttatggctctaatcttcgcacccaccagaggttgcacacaggagagaaaccctacacttgttgtgaatgtgggaagggtttcagatatggctcaggtctccttagtcataagagagtgcacactggcgagaagccatacagatgccacgtgtgtgggaagggctatagtcagagctcacatcttcaaggtcatcagagggtccacactggtgagaaaccctataaatgtgaggagtgtgggaagggctttggccgcaactcctgtcttcatgttcatcagagagtccacactggagagaagccctatacgtgtggtgtgtgtgggaaaggcttcagttatacctcaggtctgcggaaccaccaaagagtgcatttaggcgagaacccttataagtagatgtacatagaggattccatctgggactcagagctttctatccatctgagagccaacacaggagaaaaaccataggaaagtgacatgtaggagggctataggagaaactgatgattttacattttctagtctgcataggaagggaacacctggatgtgtgataaataggttagcacttcagttacaaacttcagtctttaagagtctgttgtgcagcggagtaggctttaaagaaacagtgcagcagtggtttcagtaataatcctcacttccatcagaatctgcctgggagggagcttttacaatgtacaagtggtgagaatgtttccaaggtgctaattatggacatagattctttgtgtgggttgatagctaccaatgggacagtgtagaaacaagtttccacctttctaaaaccagtttggtacatatctttttaaagatcgctttataaaaacaaaaagataacattaacatttattgaaacaagtcactctgagaagaccaggaacaaagttctcttggcagatctgggtgatgtgtgtgtctcacatttttatcatgtttttatgactgttttatcttgcaggtaagctttacagctttcagaggagttgtagtacactacagaaatatgtcttctttccaggttcaaaaagcaaaatctgattggcattgcattgaattattaattaaataaatttattaattggcattgcattgaatttataggttaattttgaaagaatgtggcgtctttgaaatgctgattttttttcactttaaaaaaatgactttttttttaccactgatagtatttcatatggtccctcagtaatatttcttagagatggttaaaaataggttctgagtcatcttaagcatatttctaggaatttgttttattgctgtcatgaatataatggttttgctccagttcatttcatagtttaacatatcaaatattaggtatcttaaaaatcacaaatgctatttcaccctgcaggttagcagtattaaaatagaatcatcaaatcccccatcagtgggggcgggggggggggttgtagaaacagtctgatatggtttggctcttgtccccacccaaatctcatctcaattttaatccccacgtgtcagaggagggccttggtgggagatgattggatcacgagggcagatttctcccttgctgttctcatgatagtgagttctcatgagagctgatggttttaaggtgtagcccttcctcgctgtctctctcctgtccccttgtgaagaaggtccttatttctcttttgcgttctgccatgactaagttttcggaggcctccccagccatgtggaactgtgtgtgagttaaacctctttcctttgcaaattacctagtctcaggtagttctttatagcagtgcaaaaatggacgtaataagtcttatgtacttattggtgagagagaaaatccgtgcattgttttcaaaagaattcattaacgtatcaattcaatttctataacctttgaagtggcagtaaatatgtagtaattgatacttgggagatagttgcccacttgggcaaaaacgcatgcagaaggt

SEQ ID NO: 201835 - DNA, 5384 bp, Homo sapiens
  Payload ID: 19817
  Gene Name: zinc finger protein 229
  ENST ID: ENST00000620012
  CDS Start-End: 404-655
gaggcgtcttagagacgtgcatctccatgcggttgtactgtcaggccatgggaattaggatcggctctataggaccagtgtgaagggacaacgtgcggcggagggtcgaagcccacggatttccatgagctcggcctggcttccttcttggaattgttcgtttctcggagataattgtataaaagaaggagaaataaccccacatctcttgacactagagctccaggtcccctgaccatgggaagcagtcgcgctctggacagtaaaggtggagacaggaacttgtcagagcttggagagtttccggaatgaaaaaggcctggatcttctgcgtctccagcttaggaaaaccagagaataaatacagttgctgctgctcgcagagaacctagcagaagagaccatggagactttgacctcaaggcatgagaaaagagctcttcattctcaagcctcagccatttcccaagatagggaggagaagatcatgtctcaggagccattgagcttcaaggacgtggctgtggtcttcactgaggaggagctagagctgctggactctacccagaggcagctgtaccaagatgtgatgcaggagaatttcaggaacctactctcagtgggtgagaggaatcctctgggtaattggaactgaacttcttggagtgttcttgttcctggagagaagatatttttggcttttttacacaggttaaatcctatttttatagaactcttagtttcagctgctgtaaaaaattgccagactgagtggcatataaacaacagaagtttatttctggaaggcacagtctgagatcagggtgccagcatagttgggttctggtgaggaccctctgtcagggtgcagatagctgacttccttttgtgtcctcacgtagcagagaagagctctctgggcatctgttttctaaggacactaatttctttcctgggggttccacctccatgacttaattacctccggaagacccaccacctcctaatggtatcacgttgggatttaggatttcaacataggaatttttgaagactggggtaacagatggagaaactccaagaaatgcatctccaggagacaagaatggaaaggatacggagtatattcaagatgaagaattaaggttcttttcacacaaagagctctcctcatgcaaaatctgggaagaggtggcaggtgaattacctgggagccaagactgtagagtaaatctgcaaggaaaagacttccagttctcagaagatgctgctccccatcaagggtgggaaggagcatctacgccgtgttttccaattgagaatttcctggacagtctacaaggggatgggcttatcggtctagaaaatcaacagtttccagcctggagagctataagaccaatccccattcaaggatcttgggcaaaagcgtttgtgaaccagttaggggatgttcaagaaagatgtaaaaatctcgacacagaagacacagtatataaatgtaactgggatgatgacagcttttgctggatatcttgtcatgttgatcacagattccctgaaatagacaagccgtgtggttgcaataaatgcagaaaagactgcattaaaaactctgtacttcatcgcattaaccctggagagaatggcttgaaaagtaacgaatacagaaatggcttcagggacgatgcagaccttcccccgcatccaagagtacctttgaaagagaaactctgtcaatatgatgagtttagtgagggcttgaggcacagtgcccatcttaacagacatcaaagagttcccacaggagagaaatctgttaagagtcttgagcgtggtcggggcgtcagacagaacacgcacatacgtaaccaccccagagcccctgtgggagacatgccctatagatgtgatgtctgtggaaaggggttcaggtataaatcggttcttcttattcatcaaggggtgcacacaggaaggagaccctataaatgtgaggagtgtgggaaggcatttggtcgaagttcaaacctgcttgtccatcagagggtccacactggagagaaaccatataaatgcagcgagtgtgggaagggcttcagttacagctcagtgcttcaagtccatcagaggctgcacacaggggagaagccctacacctgcagcgagtgtggcaaaggcttctgtgccaagtctgcactgcacaaacaccagcacattcaccctggagaaaagccctacagctgtggcgagtgtggaaagggattcagctgcagctcccacctcagcagtcatcagaagacacacaccggcgagaggccctaccagtgtgacaagtgtggcaaaggtttcagtcacaactcgtaccttcaagctcaccagagagttcacatggggcagcatctgtacaaatgtaacgtgtgtggtaagagtttcagttacagctcagggcttctcatgcatcagagactgcacacaggagagaaaccctacaaatgcgagtgcgggaagagctttggccggagctccgacctccacatccatcagagggtccacacaggagagaaaccctataaatgcagtgagtgtgggaagggcttccggcggaattcagaccttcacagccaccagagggtccacacgggagagaggccctacgtgtgtgacgtgtgtgggaagggtttcatctacagctccgacctccttatccatcagagggtccacactggagagaaaccctataaatgtgctgagtgtggcaaaggcttcagttacagctcagggcttctcattcaccagagagtccacacaggcgagaaaccttacagatgccaagagtgcggaaagggctttaggtgcacatcaagccttcacaaacatcagcgagtccacacgggaaaaaagccctatacgtgtgatcagtgtggcaagggattcagttatggctctaatcttcgcacccaccagaggttgcacacaggagagaaaccctacacttgttgtgaatgtgggaagggtttcagatatggctcaggtctccttagtcataagagagtgcacactggcgagaagccatacagatgccacgtgtgtgggaagggctatagtcagagctcacatcttcaaggtcatcagagggtccacactggtgagaaaccctataaatgtgaggagtgtgggaagggctttggccgcaactcctgtcttcatgttcatcagagagtccacactggagagaagccctatacgtgtggtgtgtgtgggaaaggcttcagttatacctcaggtctgcggaaccaccaaagagtgcatttaggcgagaacccttataagtagatgtacatagaggattccatctgggactcagagctttctatccatctgagagccaacacaggagaaaaaccataggaaagtgacatgtaggagggctataggagaaactgatgattttacattttctagtctgcataggaagggaacacctggatgtgtgataaataggttagcacttcagttacaaacttcagtctttaagagtctgttgtgcagcggagtaggctttaaagaaacagtgcagcagtggtttcagtaataatcctcacttccatcagaatctgcctgggagggagcttttacaatgtacaagtggtgagaatgtttccaaggtgctaattatggacatagattctttgtgtgggttgatagctaccaatgggacagtgtagaaacaagtttccacctttctaaaaccagtttggtacatatctttttaaagatcgctttataaaaacaaaaagataacattaacatttattgaaacaagtcactctgagaagaccaggaacaaagttctcttggcagatctgggtgatgtgtgtgtctcacatttttatcatgtttttatgactgttttatcttgcaggtaagctttacagctttcagaggagttgtagtacactacagaaatatgtcttctttccaggttcaaaaagcaaaatctgattggcattgcattgaattattaattaaataaatttattaattggcattgcattgaatttataggttaattttgaaagaatgtggcgtctttgaaatgctgattttttttcactttaaaaaaatgactttttttttaccactgatagtatttcatatggtccctcagtaatatttcttagagatggttaaaaataggttctgagtcatcttaagcatatttctaggaatttgttttattgctgtcatgaatataatggttttgctccagttcatttcatagtttaacatatcaaatattaggtatcttaaaaatcacaaatgctatttcaccctgcaggttagcagtattaaaatagaatcatcaaatcccccatcagtgggggcgggggggggggttgtagaaacagtctgatatggtttggctcttgtccccacccaaatctcatctcaattttaatccccacgtgtcagaggagggccttggtgggagatgattggatcacgagggcagatttctcccttgctgttctcatgatagtgagttctcatgagagctgatggttttaaggtgtagcccttcctcgctgtctctctcctgtccccttgtgaagaaggtccttatttctcttttgcgttctgccatgactaagttttcggaggcctccccagccatgtggaactgtgtgtgagttaaacctctttcctttgcaaattacctagtctcaggtagttctttatagcagtgcaaaaatggacgtaataagtcttatgtacttattggtgagagagaaaatccgtgcattgttttcaaaagaattcattaacgtatcaattcaatttctataacctttgaagtggcagtaaatatgtagtaattgatacttgggagatagttgcccacttgggcaaaaacgcatgcagaaggtggagtttttaaatttaaaacatttttaaaatagcaaatgttaatattccagtttccattggtaggaaattttttagataagttcaggcatatgtatgcaatggaaagccactagaaatcttcaggcacacagataatgacaatgcaggttgctcatgaagtatttagtgaaccaggagagttttagaacaacaattatagcatgaccccattttgttagtatgtttttctgtgtgtatgtttagagcaacagagaaaaaaagatgtgggagaggacatataactacttatctctagtggtgggattctgaatgtataatacatatgttgtacttttatgtattttactttgtaacaaagtatctttcagttttataataacagtagagctattttttataaattagcctgatggaacaatcccttatgattaaagattcatgttgtaacctct

SEQ ID NO: 201836 - DNA, 3186 bp, Homo sapiens
  Payload ID: 19818
  Gene Name: zinc finger protein 23
  Uniprot ID: P17027
  ENST ID: ENST00000357254
  CDS Start-End: 759-2690
ggcactcagacaacgtctatgtgtaaaggcgaccaccttattaggtctcctgcagcagccaagaccaaacacattgaagtatgtgtttttaaacgacagatgacggtcctcttttttttctctttcattacacttaaggcataacattagtttttaatatgtaggtgtgtatgttatgtatgattttctaggccattatatatgaatatcaggtcaggagaataagatggacattacaaactatttgttagaaaaagggggcattgggtgtgacagcgcgccatccactggtccatttccaagactcccacacgtggctgcacctgcagcttcacctccccgggctgggtccccgcttggctctgattcttacctgccccattccccaggggtaacagtcaccgtgggccagacccgagctagccgacagggatgcggccacagctggccgggcgtgaccaccaccgaggcgcagcgaccttgctcctagagaggcccggccgcctggtgacgcacttccggcagcgccggggagcagtccgctacggagctccagcccttctctgagacggggaccaggggatggcagccatgcacctgacagcctggccccagggcctgagctatggaattggccctagggcagcaggaacctattgtttcagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaaaaa

SEQ ID NO: 201837 - DNA, 2692 bp, Homo sapiens
  Payload ID: 19818
  Gene Name: zinc finger protein 23
  ENST ID: ENST00000358700
  CDS Start-End: 161-412
agctccagcccttctctgagacggggaccaggggatggcagccatgcacctgacagcctggccccagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgatggagtctcgctctgtcgcccaaactggagtgcagtggcaagaacttggctcaccgcaacttccgtttcccgggttcgagcaattctcctgcctcatcctcccgagtagctggaactacaggcacatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaa

SEQ ID NO: 201838 - DNA, 3242 bp, Homo sapiens
  Payload ID: 19818
  Gene Name: zinc finger protein 23
  Uniprot ID: P17027
  ENST ID: ENST00000393539
  CDS Start-End: 815-2746
cggaggtgagtgcagggctccgggcgctgtgtgccgtgccctgtcccccaggctctgggtccggttgagacgcactcccaccctgggtgctgcagggtctcccgtggcctacgctgccaggaggcccaggctgggagagggagcagggcggcggcccggggtgctcttccgcgctcctcgactccagctttggtctttgtggctcaatagcttgcgcccattggaaggggaaacgcacgttgctgtcccagccacgaggccctgagcatttagcacttggtcgacgggggaagatgtgtcggtgcagctaaaagatggaatatttgcgggcgtgaagcggcccgaggtgataccacaagtcttttgacatgctgaggtctggcaggaacattaacctatgtgcatcccgagtatggaccgtgtgctcccaggctcctgacatagggtcatgaattagggccgagtgggagcgcagagcccctcccagtcacccggcagcagaagcagcccggcttttggaggacattgtctcctggagcagtgtcagtcccaaaagctccagcccttctctgagacggggaccaggggatggcagccatgcacctgacagcctggccccagggacttcacggatcccctgaagctcatccatggacttccatggactacagggcctgagctatggaattggccctagggcagcaggaacctattgtttcagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaaaaa

SEQ ID NO: 201839 - DNA, 1932 bp, Homo sapiens
  Payload ID: 19818
  Gene Name: zinc finger protein 23
  Uniprot ID: P17027
  ENST ID: ENST00000428724
  CDS Start-End: 1-1932
atgctggagaattatgggaatgtggcctccctgggatttccacttctcaaacctgctgtgatctcacaactggagggaggaagtgagctggggggctcatctccactggctgcaggaacaggcctccagggcctccagactgatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaa

SEQ ID NO: 201840 - DNA, 555 bp, Homo sapiens
  Payload ID: 19818
  Gene Name: zinc finger protein 23
  ENST ID: ENST00000565718
  CDS Start-End: 245-555
acttccggcagcgccggggagcagtccgctacggagctccagcccttctctgagacggggaccaggggatggcagccatgcacctgacagcctggccccagggcctgagctatggaattggccctagggcagcaggaacctattgtttcagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaatagatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttag

SEQ ID NO: 201841 - DNA, 558 bp, Homo sapiens
  Payload ID: 19818
  Gene Name: zinc finger protein 23
  ENST ID: ENST00000567340
  CDS Start-End: 478-558
aacattgctactagcgttgtggataggagccaggatcctgcaatgtacaggacagtcctgcccactgaaaaaatgttcacactttcaaatgtcttgctgaacattcaggggtaacagtcaccgtgggccagacccgagctagccgacagggatgcggccacagctggccgggcgtgaccaccaccgaggcgcagcgaccttgctcctagagaggcccggccgcctggtgacgcacttccggcagcgccggggagcagtccgctacggagctccagcccttctctgagacggggaccaggggatggcagccatgcacctgacagcctggccccagggcctgagctatggaattggccctagggcagcaggaacctattgtttcagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggagga

SEQ ID NO: 201842 - DNA, 2799 bp, Homo sapiens
  Payload ID: 19818
  Gene Name: zinc finger protein 23
  ENST ID: ENST00000497160
  CDS Start-End: 246-497
cacttccggcagcgccggggagcagtccgctacggagctccagcccttctctgagacggggaccaggggatggcagccatgcacctgacagcctggccccagggacttcacggatcccctgaagctcatccatggacttccatggactacagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgatggagtctcgctctgtcgcccaaactggagtgcagtggcaagaacttggctcaccgcaacttccgtttcccgggttcgagcaattctcctgcctcatcctcccgagtagctggaactacaggcacatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaaaaa

SEQ ID NO: 201843 - DNA, 3020 bp, Homo sapiens
  Payload ID: 19818
  Gene Name: zinc finger protein 23
  Uniprot ID: P17027
  ENST ID: ENST00000564528
  CDS Start-End: 767-2524
ggttactgaggggatctctggtaatcctttactgagtgagaaccccagagctgttcctaatctagacttagaggttactggcaggggcaaatgccaagccttttgtaggcctatataggactttgcttggaactggtatgcactgttgatccaacccatgaaagctatgttttggaaacactggaatccagttgcttcctgttccacagtggcatcttcagttgccccctcatcttacctgtcttgagtcttttcaaggatctcagtgtactctggattatttcaggccaaggtcaaaaagtggtatccctttgggcagaatctccctgcttgccctgcatgaggtctcctaggcctacagtctgggccctaaccaggctctcccacacgttcccaagccttcacccccaacccccacatttgcctcccaaagcccttggaagtctccaaggtctctttagtccttcctaagccccacagtactttcccgtagtcctgaggcttgggacctcctggggttcttaccttccctccccattgctgagacagtctgagaagaggcttaggaatttgtctgtgggagtttattcatctgtctctcctatttacctctcccaaaccaggatttccacttctcaaacctgctgtgatctcacaactggagggaggaagtgagctggggggctcatctccactggctgcaggaacaggcctccagggcctccagactgtagatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaaaaa

SEQ ID NO: 201844 - DNA, 4115 bp, Homo sapiens
  Payload ID: 19819
  Gene Name: zinc finger protein 230
  Uniprot ID: Q9UIE0
  ENST ID: ENST00000429154
  CDS Start-End: 229-1653
acttccggtgtgtgagcctgcggttgctacataaccgcgtagtttgagccatttctgcgtctggcgggtccttctgaacttgtcaccttcgcttggggtcgcaacgacccgatgatcgatgatccaagcaagggaaaagaagccttggcggagagcggaggcacaattccaccttcctttgtgctccattactcaagacactgaagactccaaaaagtagtaggaaaaatgaccacattcaaggaggcagtgaccttcaaggatgtggctgtgttcttcactgaggaggaactggggctactggaccctgcccagaggaagctgtaccaagacgtgatgcttgagaacttcacgaacctgctgtcagtggggcatcaaccattccaccctttccacttcctaagggaagaaaagttttggatgatggagacagcaacccaaagagaaggaaattcaggcggcaagactattgcggaagcaggaccacatgaagactgcccttgccagcaaatctgggaacaaactgcaagtgacttaacccagtctcaagactccatcataaataattctcacttctttgaacaaggtgatgtcccctcccaggttgaggcaggactatctataattcatacaggacagaaaccttcacagaatgggaagtgtaaacagtccttcagtgatgttgccatctttgatcctcctcagcagttccactcaggagagaagtctcatacatgcaatgagtgtggaaaaagcttctgttacatctcagctcttcgtattcaccagagagttcacttgagagagaaactctctaagtgtgacatgcgtggtaaggaattcagtcagagctcatgtctgcaaactcgtgagagagtccacactggagagaaaccattcaaatgtgagcaatgtgggaaaggcttcagatgtagagcgatacttcaagttcactgcaaattacacacaggagagaaaccttatatttgtgagaaatgtgggagggccttcattcacgatttccagcttcagaaacatcagataattcatactggggagaagccgttcaaatgtgaaatatgtggtaagagcttctgccttaggtcaagtcttaataggcattgcatggtccacacagcagagaaactgtacaaatctgaggagtgtggaaaaggcttcactgatagcctagatttgcataagcatcagataattcacacaggacagaaaccgtacaattgtaaagaatgtgggaagagcttcagatggtcctcatatcttttgatccatcagcgaatccacagtggagaaaaaccatacagatgtgaggagtgtgggaagggctacattagtaagtcaggtcttaacttgcaccagagggtccatactggagagagaccttataattgtaaggaatgtgggaagagctttagccgggcttcaagtattttgaatcataagaaactccactgccggaaaaaacccttcaaatgtgaggattgtggaaagaggcttgtacaccggtctttctgtaaagaccaacaaggagaccacaatggagaaaactcatccaaatgtgaggactgtgggaagcgctacaagaggcgcttgaatctggatataattttatcattatttttaaatgatatgtaagttgtacatatatatgggatatggtatgaaattttaatatgtgtatataatacgtaatgatcaaattgatgtaattagtgtattaccttaaacaattaacatttctttgttttgggaaaattcaaaatccattgttctagcgatttgaaaagaaacaataaattattgttgattatagtcacctttggtgctttagaacactagaatgtatttctcctatctagcagtacttatgtatcttgttacccaatctttggctatctcacctaacccctacacttccctgcttctagaaccactgttttactcactaattctatgaaatcaacttttttagcttccatatgtgtgtgaggacagttagtatttatcttaccttgcttagcttatattgtttaacatgtcctccaaagctcatctatgttgccacaaatgacacaattttgttttctttttatgcccaaagagtattctattgtgtatatatgccaccttttcttcatttatctattgatggacacataggtgggttccatatcttaactattgtgaagaatagtgctccaatgaacatggtagtgtagatatctgatccacatactgatttcctttgctttggatatactcaatagtgggattgctagatcactcgaatcttatgcctcagaggcttgacacaagagcaaaactatggaagtgtggctagggtgatatggcttcataccacctcaggcctcaagtcctcaactgcaccagagtgtccacgttggacagaatccttagtaatgaggtgtgtgataaagtctctgctcagttgtctataatctcatttgagagttcacaaaggggcaaaacattaaaaagaggcatatggtaagcacttcagtgtgtgtttatatcataatttatcacagtccatactgataatatatttcatccaggcttgtaggacagaaaacatttgtttaagttaaattcagtgtttcaccatagctcagcattctcccatcatcctaggaccatcgtagtagagaactcttgtaaattgtgcagtagggttgcaaacagaacttacgcttgtcattcaggagacaggccttagaataagagtttgttcacacatttacaaaaccctaatgatgaacatgtcaaaagtggtgaccactagaatgtcaactacaggtaccttgttttctgcatcctcaggaccttaacactgattagcacttacatgtttagtatgtgttaaatgactcaaaaggagaaaatatgatattttaaaattgcatctaggagagaaaatctacaaaaaataattcagggacacgagttaaaatgcagaatacactcagttctgcaatccaaagcattattttgggtaatcttaccctgttgcacttggctgctggcttcccctcatcctctgttctgaagtttactactagtggctttgtctaatgctccattggttgcatacaatataaattcaacaatcatttgtaactcttctcacactacaggctgaaaatggtttgttaacttgtcaataacagtccactgcatatatcacaattacatttttttcaacagtgttaaggcaaaatttatagtaatactttttacgtggcagatgtagttacgttggaaaaaacttccttagttctgaattctcatgattgcttctgtatttccatgcaggccttgatataatggccttctaattgtggtagcatttattttatcaaacaactcaggtagaagctatgccaatttgacaatttttggaaacctaacctaatattctcttcctatctctatgaaataccaagagaaacctatcggagtttggtaatttcatgaaatgtatccatgattggggtaggagtgacatttacatgctcttctttattgttggcagtaaaaataagtcttttgtaagcagtgtatatcagaatgtataaggtacaagtgttttacctggaaatgatgggataggaaattatgattatgatgttaaaactgtgaaaagtagaaaaccacatggatgatatcaccccattttaaaatggaataagtattcaacaagaatttgtgtgaaatgcatttattcctataacataagaccaataaaatgagggaaccagacatacagtaaaaggagaaaaacataatgtgagctttgtgaaatctgactgtaaccttcataacataatcaaatatctttgtgtgtttctgggactttttaatgtgtatatacgtaatttgtgaacaactattctttcctctggcaatgaatatttgctggtatttttccattttataattttatgcattttttctcagtgaacatcagttttatcaaagcagtaaatttagtgcaataaatttgcaaacttattaacgttaatcacttacctaccaggactcagaatctcagaataaaattgctctatattgtcata

SEQ ID NO: 201845 - DNA, 4085 bp, Homo sapiens
  Payload ID: 19819
  Gene Name: zinc finger protein 230
  ENST ID: ENST00000585568
  CDS Start-End: 201-365
acataaccgcgtagtttgagccatttctgcgtctggcgggtccttctgaacttgtcaccttcgcttggggtcgcaacgacccgatgatcgatgatccaagcaagggaaaagaagccttggcggagagcggaggcacaattccaccttcctttgtgctccattactcaagacactgaagactccaaaaagtagtaggaaaaatgaccacattcaaggaggcagtgaccttcaaggatgtggctgtgttcttcactgaggaggaactggggctactggaccctgcccagaggaagctgtaccaagacgtgatgcttgagaacttcacgaacctgctgtcagtgggtgagcacaggcaccctctgtaatggtacatcaggcctcaggagtggctttgtatcctagagtattcaagtttgtggcatcaaccattccaccctttccacttcctaagggaagaaaagttttggatgatggagacagcaacccaaagagaaggaaattcaggcggcaagactattgcggaagcaggaccacatgaagactgcccttgccagcaaatctgggaacaaactgcaagtgacttaacccagtctcaagactccatcataaataattctcacttctttgaacaaggtgatgtcccctcccaggttgaggcaggactatctataattcatacaggacagaaaccttcacagaatgggaagtgtaaacagtccttcagtgatgttgccatctttgatcctcctcagcagttccactcaggagagaagtctcatacatgcaatgagtgtggaaaaagcttctgttacatctcagctcttcgtattcaccagagagttcacttgagagagaaactctctaagtgtgacatgcgtggtaaggaattcagtcagagctcatgtctgcaaactcgtgagagagtccacactggagagaaaccattcaaatgtgagcaatgtgggaaaggcttcagatgtagagcgatacttcaagttcactgcaaattacacacaggagagaaaccttatatttgtgagaaatgtgggagggccttcattcacgatttccagcttcagaaacatcagataattcatactggggagaagccgttcaaatgtgaaatatgtggtaagagcttctgccttaggtcaagtcttaataggcattgcatggtccacacagcagagaaactgtacaaatctgaggagtgtggaaaaggcttcactgatagcctagatttgcataagcatcagataattcacacaggacagaaaccgtacaattgtaaagaatgtgggaagagcttcagatggtcctcatatcttttgatccatcagcgaatccacagtggagaaaaaccatacagatgtgaggagtgtgggaagggctacattagtaagtcaggtcttaacttgcaccagagggtccatactggagagagaccttataattgtaaggaatgtgggaagagctttagccgggcttcaagtattttgaatcataagaaactccactgccggaaaaaacccttcaaatgtgaggattgtggaaagaggcttgtacaccggtctttctgtaaagaccaacaaggagaccacaatggagaaaactcatccaaatgtgaggactgtgggaagcgctacaagaggcgcttgaatctggatataattttatcattatttttaaatgatatgtaagttgtacatatatatgggatatggtatgaaattttaatatgtgtatataatacgtaatgatcaaattgatgtaattagtgtattaccttaaacaattaacatttctttgttttgggaaaattcaaaatccattgttctagcgatttgaaaagaaacaataaattattgttgattatagtcacctttggtgctttagaacactagaatgtatttctcctatctagcagtacttatgtatcttgttacccaatctttggctatctcacctaacccctacacttccctgcttctagaaccactgttttactcactaattctatgaaatcaacttttttagcttccatatgtgtgtgaggacagttagtatttatcttaccttgcttagcttatattgtttaacatgtcctccaaagctcatctatgttgccacaaatgacacaattttgttttctttttatgcccaaagagtattctattgtgtatatatgccaccttttcttcatttatctattgatggacacataggtgggttccatatcttaactattgtgaagaatagtgctccaatgaacatggtagtgtagatatctgatccacatactgatttcctttgctttggatatactcaatagtgggattgctagatcactcgaatcttatgcctcagaggcttgacacaagagcaaaactatggaagtgtggctagggtgatatggcttcataccacctcaggcctcaagtcctcaactgcaccagagtgtccacgttggacagaatccttagtaatgaggtgtgtgataaagtctctgctcagttgtctataatctcatttgagagttcacaaaggggcaaaacattaaaaagaggcatatggtaagcacttcagtgtgtgtttatatcataatttatcacagtccatactgataatatatttcatccaggcttgtaggacagaaaacatttgtttaagttaaattcagtgtttcaccatagctcagcattctcccatcatcctaggaccatcgtagtagagaactcttgtaaattgtgcagtagggttgcaaacagaacttacgcttgtcattcaggagacaggccttagaataagagtttgttcacacatttacaaaaccctaatgatgaacatgtcaaaagtggtgaccactagaatgtcaactacaggtaccttgttttctgcatcctcaggaccttaacactgattagcacttacatgtttagtatgtgttaaatgactcaaaaggagaaaatatgatattttaaaattgcatctaggagagaaaatctacaaaaaataattcagggacacgagttaaaatgcagaatacactcagttctgcaatccaaagcattattttgggtaatcttaccctgttgcacttggctgctggcttcccctcatcctctgttctgaagtttactactagtggctttgtctaatgctccattggttgcatacaatataaattcaacaatcatttgtaactcttctcacactacaggctgaaaatggtttgttaacttgtcaataacagtccactgcatatatcacaattacatttttttcaacagtgttaaggcaaaatttatagtaatactttttacgtggcagatgtagttacgttggaaaaaacttccttagttctgaattctcatgattgcttctgtatttccatgcaggccttgatataatggccttctaattgtggtagcatttattttatcaaacaactcaggtagaagctatgccaatttgacaatttttggaaacctaacctaatattctcttcctatctctatgaaataccaagagaaacctatcggagtttggtaatttcatgaaatgtatccatgattggggtaggagtgacatttacatgctcttctttattgttggcagtaaaaataagtcttttgtaagcagtgtatatcagaatgtataaggtacaagtgttttacctggaaatgatgggataggaaattatgattatgatgttaaaactgtgaaaagtagaaaaccacatggatgatatcaccccattttaaaatggaataagtattcaacaagaatttgtgtgaaatgcatttattcctataacataagaccaataaaatgagggaaccagacatacagtaaaaggagaaaaacataatgtgagctttgtgaaatctgactgtaaccttcataacataatcaaatatctttgtgtgtttctgggactttttaatgtgtatatacgtaatttgtgaacaactattctttcctctggcaatgaatatttgctggtatttttccattttataattttatgcattttttctcagtgaacatcagttttatcaaagcagtaaatttagtgcaataaa

SEQ ID NO: 201846 - DNA, 579 bp, Homo sapiens
  Payload ID: 19819
  Gene Name: zinc finger protein 230
  ENST ID: ENST00000585632
  CDS Start-End: 199-462
ataaccgcgtagtttgagccatttctgcgtctggcgggtccttctgaacttgtcaccttcgcttggggtcgcaacgacccgatgatcgatgatccaagcaagggaaaagaagccttggcggagagcggaggcacaattccaccttcctttgtgctccattactcaagacactgaagactccaaaaagtagtaggaaaaatgaccacattcaaggaggcagtgaccttcaaggatgtggctgtgttcttcactgaggaggaactggggctactggaccctgcccagaggaagctgtaccaagacgtgatgcttgagaacttcacgaacctgctgtcagtggggcatcaaccattccaccctttccacttcctaagggaagaaaagttttggatgatggagacagcaacccaaagagaaggaaattcaggtaagaagcaagcaactgtgtgtccttgtacatgactttctttcccatttgttttacttctgaccatgcccacttatatcaccctgatctaaattgcccaatctctttcctggtttattacaacccctttctggctggtggtcctgttccct

SEQ ID NO: 201847 - DNA, 600 bp, Homo sapiens
  Payload ID: 19819
  Gene Name: zinc finger protein 230
  ENST ID: ENST00000585491
  CDS Start-End: 380-600
tataaatggaatcatctaatccatggattttggtgactggcttctttctcttatgatgtttccaaggtttgtgcatgttgtagcatgggttggtacttcattccttttaatttccaaattagattccattatatggatatgccatgatttttctatccatttacccagaggaaggcattttggttgtgcacagttttggggttagtatgaataatgctgctgtgatcattcataatacatgtgcttgttgctacacagcctccccagccaccatttcatgtctctcttttgctgtctctggcattttccaggcacaattccaccttcctttgtgctccattactcaagacactgaagactccaaaaagtagtaggaaaaatgaccacattcaaggaggcagtgaccttcaaggatgtggctgtgttcttcactgaggaggaactggggctactggaccctgcccagaggaagctgtaccaagacgtgatgcttgagaacttcacgaacctgctgtcagtggggcatcaaccattccaccctttccacttcctaagggaagaaaagttttggatgatggagacagcaacccaaagagaagg

SEQ ID NO: 201848 - DNA, 2179 bp, Homo sapiens
  Payload ID: 19820
  Gene Name: zinc finger protein 232
  Uniprot ID: Q9UNY5
  ENST ID: ENST00000250076
  CDS Start-End: 656-1990
cgacgacaaggatggggcccatctcttcggagcctaaggatccagcccaggtccagccctgcgcagccgcccaccaagctgccagaagacgagccggacgcccaaggctacgagaggacgattgcagaattgtacaggctagtggttggggaatattttttcgtggaagggaccgtcttccttagctgtggccctctcatcaggtctgggaagaggtaattggaaaatagaactcatggagaagtgttaccacaggccatggacaaggccagaatttccctgacatctgtccgccagcaccgcccttcaggtacaattccacaagagaccccccaaacttgatgaagtcacccgcttacaagggctcactctccacctgcgcaaggactgcaattcccaggggcctccagggcacccggccgctccagtccagtcgtgcaggcggcgcgctctttctcgctccgctcaagtccaggaaccggttcccgggctcccagcctctcggcagcgcccacgcgcctgggccaaagtccgcgaacggaagccggcggcgaggaggattctgggagttggaggccgaggctgcgacctgcgcaggcgcaaacctgcccctggggtgagggctgtaagtggcgcgattcgcggcagcgccccgatggaacctcctggtcctgtgagggggcccttgcaagattccagctggtatgagccttctgcagagctagtgcagactaggatggctgtatcactaacagcagctgaaactctggcccttcagggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtcccaggccctgcacatggacctgcacaggaagagccatgggagaagaaggaatctctgggagcagcccaggaagcactgagcatccagctccagcctaaggagacccagcctttcccaaagagtgaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattgaattgaaggggagaacgtctccagacagaattctacatcggtctaatctactttaggactggatcccataaaagttataagttccttaagatttttcctgtgtctttcttgattttggaaaaactgtttacttagttctgcctgtagatcatcccttcatgtcctctgatgaagatactgatattaatta

SEQ ID NO: 201849 - DNA, 2384 bp, Homo sapiens
  Payload ID: 19820
  Gene Name: zinc finger protein 232
  ENST ID: ENST00000570486
  CDS Start-End: 670-822
gacggcgcccgcgacgacgacaaggatggggcccatctcttcggagcctaaggatccagcccaggtccagccctgcgcagccgcccaccaagctgccagaagacgagccggacgcccaaggctacgagaggacgattgcagaattgtacaggctagtggttggggaatattttttcgtggaagggaccgtcttccttagctgtggccctctcatcaggtctgggaagaggtaattggaaaatagaactcatggagaagtgttaccacaggccatggacaaggccagaatttccctgacatctgtccgccagcaccgcccttcaggtacaattccacaagagaccccccaaacttgatgaagtcacccgcttacaagggctcactctccacctgcgcaaggactgcaattcccaggggcctccagggcacccggccgctccagtccagtcgtgcaggcggcgcgctctttctcgctccgctcaagtccaggaaccggttcccgggctcccagcctctcggcagcgcccacgcgcctgggccaaagtccgcgaacggaagccggcggcgaggaggattctgggagttggaggccgaggctgcgacctgcgcaggcgcaaacctgcccctggggtgagggctgtaagtggcgcgattcgcggcagcgccccgatggaacctcctggtcctgtgagctgcaagatagaaagcaacatatgcccccaggtggcctccctcaccctggcaatggaaacgaacagccgagcttcaccggacaagactagaaatcgttcctccacccacccagagacaaagcatatttgacttcttcctctactggggcccttgcaagattccagctggtatgagccttctgcagagctagtgcagactaggatggctgtatcactaacagcagctgaaactctggcccttcagggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtgggaagggggatttggtctgttatgggagccagattgatgaccttcaggctggaccgaggggcagctgtagggggaggtgccaagttcaaacctctcttgggccaggtagagcagttagtatgtgtttctgtgtctgtcttttctgccctcgagccctgaatgagaaagagactctagctcctcttcttcccttgtgctgactctgaggaggctctctaaagtctccttggaagctttggtccaaggagggtcacatctgcaagtgtccaggcaggggacagaaaccacactagtaatttgaagaaaatttaaactgagtggtgcctgatcacctccaggtcccaggccctgcacatggacctgcacaggaagagccatgggagaagaaggaatctctgggagcagcccaggaagcactgagcatccagctccagcctaaggagacccagcctttcccaaagagtgaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagt

SEQ ID NO: 201850 - DNA, 581 bp, Homo sapiens
  Payload ID: 19820
  Gene Name: zinc finger protein 232
  ENST ID: ENST00000571076
  CDS Start-End: 20-172
gattcgcggcagcgccccgatggaacctcctggtcctgtgagctgcaagatagaaagcaacatatgcccccaggtggcctccctcaccctggcaatggaaacgaacagccgagcttcaccggacaagactagaaatcgttcctccacccacccagagacaaagcatatttgacttcttcctctactggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtcccaggccctgcacatgg

SEQ ID NO: 201851 - DNA, 1553 bp, Homo sapiens
  Payload ID: 19820
  Gene Name: zinc finger protein 232
  ENST ID: ENST00000573015
  CDS Start-End: 24-176
gcgcgattcgcggcagcgccccgatggaacctcctggtcctgtgagctgcaagatagaaagcaacatatgcccccaggtggcctccctcaccctggcaatggaaacgaacagccgagcttcaccggacaagactagaaatcgttcctccacccacccagagacaaagcatatttgacttcttcctctactggggcccttgcaagattccagctggtatgagccttctgcagagctagtgcagactaggatggctgtatcactaacagcagctgaaactctggcccttcagggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtcccaggccctgcacatggacctgcacaggaagagccatgggagaagaaggaatctctgggagcagcccaggaagcactgagcatccagctccagcctaaggagacccagcctttcccaaagagtgaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattgaattgaaggggagaacgtctccagacagaattctacatcggtctaatctact

SEQ ID NO: 201852 - DNA, 1610 bp, Homo sapiens
  Payload ID: 19820
  Gene Name: zinc finger protein 232
  ENST ID: ENST00000575898
  CDS Start-End: 20-1327
gattcgcggcagcgccccgatggaacctcctggtcctgtgagggggcccttgcaagattccagctggtatgagccttctgcagagctagtgcagactaggatggctgtatcactaacagcagctgaaactctggcccttcagggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtcccaggccctgcacatggacctgcacaggaagagccatgggagaagaaggaatctctgggagcagcccaggaagcactgagcatccagctccagcctaaggagacccagcctttcccaaagagtgttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattgaattgaaggggagaacgtctccagacagaattctacatcggtctaatctactttaggactggatcccataaaagttataagttccttaagatttttcctgtgtctttcttgattttggaaaaactgtttacttagttctgcctgtagatcatcccttcatgtcctctgatgaagatactgatattaattaggatgctttggatgcaagtagtagccaagttgttttgcttctttccagcatgatctgcctagtttgcccaccaataatgtctacctcattagaa

SEQ ID NO: 201853 - DNA, 2784 bp, Homo sapiens
  Payload ID: 19821
  Gene Name: zinc finger protein 233
  Uniprot ID: A6NK53
  ENST ID: ENST00000391958
  CDS Start-End: 128-2140
ctatcccctctgggaggtgagtcagcgcggaacctctgcatctacggcgagctttcctggcctgggcgttggactcgcagttctgccttcccaggaccctgcccttccccagaaggagcaggagaaaatgaccaagtttcaggagatggtgacattcaaggatgtggctgtggtcttcaccagggaggagctggggttgctggaccttgcccagagaaagctgtaccaagatgtgatgctggagaacttcaggaacctgctgtcagtgggctatcaacccttcaaactagatgtgatattacagttgggaaaagaagacaagcttcggatgatggagacagaaatccaaggagatgggtgttcaggacacaagaatcaaaatgagatagatacccttcaagaagtaagattaagattcctttcatatgaagaccttatatgctggcaaatatgggaacaatttacaagtaaattaaccagtaatcaagacctaataataaatcttcaaggcaagaggtccaagttgctaaaacaaggtgattccccctgtcaggtgtggacaggagaatctagtcaggtctctgaagatgagaactatgtaataaagctacaaggggagagttcaaatagcataaaaaatcaagagcttccattgaggaccacctgggatttctggaggaaaatgtatctgagagaaccacagaattatcagagtaggtgtcagcaaattgatgtaaaaaataagctctgtaaatgtgatcattgtgttaggcaaagaattgctcatcaacatgatgatcatggagtacacaaaagagagaaagcttttagccacaataattgtggaaaagactgtgtgaaggaatcatcccagcatagcataatccaatcaggagagcaaacctctgatgaaaatggaaaaggcttaagtgttggctctaatcttgaacttcaccagcaactacacttaagagacaagcctcatgtaaatgttgagtacgggaagggcataggttacagctcagggcttcccaggcatcagtgtttccacataggagagaaatgctataggaatggtgacagtggtgagggcttcagtcagggctcacatctgcaacctcatcagagagtcagcacaggagagaacctctacagatgtcaggtatatgcccggagctccaaccagaactcctgtcttccctctcatgagcttactcacccaggagagaagttgtgtacatgtggcaggtgtgggaagggcttccatcatagcttagattttgacattcactgtgtagacagtgctggagagagagcctgtaaatgtgatgtatatgataaaggcttcagtcagacatcacaacttcaagcccatcagagaggtcactctagagacaagacatacaaatgggaagtaagtgacaggatatttaataggaattctggtcttcaccagagagttcacactggagagaaaccatataaatgtgaggtatgtgataagggcttcagtaaggcctcaaatcttcaagcccatcagagaatccacactggagagaaaccctacaaatgtgatgtgtgtgataagaacttcagccgtaattcccaccttcaggcccatcagagagtccatacaggagagaaaccctacaaatgtgacacatgtgggaaggacttcagtcagatctctcatcttcaggcccatcagagagttcacaaaggagagaagccatacaaatgtgagacatgtgggaagggctttagtcagagttcgcatctccaagaccatcagcaagtccatactggagagaatccctacaaatgtgatgtgtgtgggaaaggcttcagttggagttcacatcttcaagcccatcagagagtccacacaggagagaaaccatacaaatgtgaagaatgtaggaaaggcttcatctggaactcatatcttcatgttcatcagaggatccacacgggagagaaaccctataaatgtggcatgtgtggtaagagcttcagtcagacttcacatcttcaagcccatcagagagtccatactggagagaaaccatacaaatgttttgtgtgtggtaagggctttagtaagagttcgttgtcttcagattcatcagagagtccatgatggtgatgaatctattaatcatgatgagtgtgataggggtgctcttcaagacttagacttcccattttcctcagaaaatccacacagcacagaatatttataaaatgtcatgttttaagaattcatgagctgagtttttatagttatctgaattccattgaagaaaacctatttttgtatgaatatgaccagtttcaagcagagcccaaaatgtcacagttgtcaagagaacacacaacagagaaaccctataaagaatgatacaatatgtttcaatcagaaccttcacatccaataagcaatatgcaggagtgaagccttcaaaatgataagtaaggtcagaatttagcaaaagtataatgagggacatgacaaaatctgtgtccactagaatctaagctccatgcaggaacattgtttactgctgcatgatcgtgaccttgaacaagtacctaagaaatagtggcttccctggaattgtttaacttgataggaaaaatctatcatatataggacatatatttgaatattttagtgagctcagccccaattcgtcattataattgtactgggaaaaggattcttgcaagaagccttaaaatgaattcaaggaaatgacatttaattaaaacacataaaaccaa

SEQ ID NO: 201854 - DNA, 528 bp, Homo sapiens
  Payload ID: 19821
  Gene Name: zinc finger protein 233
  ENST ID: ENST00000588489
  CDS Start-End: 181-528
gggcgaagcagccgtcatctatcccctctgggaggtgagtcagcgcggaacctctgcatctacggcgagctttcctggcctgggcgttggactcgcaggtgcctgccctcgctctcagtgaagggaagtcgcagagggcggggacgacggtttgcttgccctttgtttttagggcggtgcatgggtctccaagttgggaatggctcctggtcgcacgtttggtttgaaggtctcccgggcgctcaagttccctcgccttccccaccttccacacgctctgctgtcttctggcaatataatcttgttctgccttcccaggaccctgcccttccccagaaggagcaggagaaaatgaccaagtttcaggagatggtgacattcaaggatgtggctgtggtcttcaccagggaggagctggggttgctggaccttgcccagagaaagctgtaccaagatgtgatgctggagaacttcaggaacctgctgtcagtgggctatcaacccttcaaactagatgtgatattacag

SEQ ID NO: 201855 - DNA, 1120 bp, Homo sapiens
  Payload ID: 19821
  Gene Name: zinc finger protein 233
  ENST ID: ENST00000589522
  CDS Start-End: 49-300
gttctgccttcccaggaccctgcccttccccagaaggagcaggagaaaatgaccaagtttcaggagatggtgacattcaaggatgtggctgtggtcttcaccagggaggagctggggttgctggaccttgcccagagaaagctgtaccaagatgtgatgctggagaacttcaggaacctgctgtcagtgggctatcaacccttcaaactagatgtgatattacagttgggaaaagaagacaagcttcggatgatggagacagaaatccaaggagatgggtgttcaggtctcactctgtgacctaggctgaagtggtggtgcaatcatggtacactgcagcctcgacctcccaggctcaatcgatcttctcacctcagcctcctgagtagctgggatgggactacaggcacttgccactatgctggactaattttaaaactatgtatatatacatgtttttttttttttggtagagatgaggtctcaccatattacccaggttggtctcaaactcctgagctcaagcaatcctcccacttcagcctcccaaagtgttaggattacaggcatgagccactgtgcccggcatacatgtatttctttctacctgaagccttttgctcttctgtctgcctgggatgttcttacctcatacatcctcttggctcccagcctacttcctttatgtctggtcagatgtcatctcatcacagaaacctgcttttttttttcttttagacggagtcttgctctgtcgccaggctggagtgctatggcgcgatcttggctcactgcaacctctgactccctggaaaactgctttgactaccctgtttaaaatacctatccttggctgggcgtgatggctcatccctgtaatctcagcactttgagaggccaaggtggcaggatcactcgaggccaggagtttaagaccagcctggacaacacagtgagaccgcacctctataaaaaaatttaaaaaattagctcacagctataactgtgccactgcactgtagcctgggcgacagagcaagaccctgtctcaaaaatacatacatacatacatacatacatacatacatacatttaattaaattaaatacccatctcttta

SEQ ID NO: 201856 - DNA, 574 bp, Homo sapiens
  Payload ID: 19821
  Gene Name: zinc finger protein 233
  ENST ID: ENST00000590668
  CDS Start-End: 87-574
gtgtacttccgctgcaggagggcgaagcagccgtcatctatcccctctgggaggaccctgcccttccccagaaggagcaggagaaaatgaccaagtttcaggagatggtgacattcaaggatgtggctgtggtcttcaccagggaggagctggggttgctggaccttgcccagagaaagctgtaccaagatgtgatgctggagaacttcaggaacctgctgtcagtgggctatcaacccttcaaactagatgtgatattacagttgggaaaagaagacaagcttcggatgatggagacagaaatccaaggagatgggtgttcaggacacaagaatcaaaatgagatagatacccttcaagaagtaagattaagattcctttcatatgaagaccttatatgctggcaaatatgggaacaatttacaagtaaattaaccagtaatcaagacctaataataaatcttcaaggcaagaggtccaagttgctaaaacaaggtgattccccctgtcaggtgtggacaggagaatctagtcaggtctctgaagatgagaactatgtaataaagctacaagg

SEQ ID NO: 201857 - DNA, 2938 bp, Homo sapiens
  Payload ID: 19821
  Gene Name: zinc finger protein 233
  ENST ID: ENST00000592581
  CDS Start-End: 107-529
aaccttgtgtacttccgctgcaggagggcgaagcagccgtcatctatcccctctgggagttctgccttcccaggaccctgcccttccccagaaggagcaggagaaaatgaccaagtttcaggagatggtgacattcaaggatgtggctgtggtcttcaccagggaggagctggggttgctggaccttgcccagagaaagctgtaccaagatgtgatgctggagaacttcaggaacctgctgtcagtgggctatcaacccttcaaactagatgtgatattacagttgggaaaagaagacaagcttcggatgatggagacagaaatccaaggagatgggtgttcaggtgagaaccatggagctctgagtctttgcggggtacagcctagtcctctcctcctcaccacctcctcagccaccagcctggcccaagaccccagaattcatcgccctggtttactgcagcagcttgcacatgaccttcctccttctacctccctccagtccattctccacatagccagatcatgacacaagaatcaaaatgagatagatacccttcaagaagtaagattaagattcctttcatatgaagaccttatatgctggcaaatatgggaacaatttacaagtaaattaaccagtaatcaagacctaataataaatcttcaaggcaagaggtccaagttgctaaaacaaggtgattccccctgtcaggtgtggacaggagaatctagtcaggtctctgaagatgagaactatgtaataaagctacaaggggagagttcaaatagcataaaaaatcaagagcttccattgaggaccacctgggatttctggaggaaaatgtatctgagagaaccacagaattatcagagtaggtgtcagcaaattgatgtaaaaaataagctctgtaaatgtgatcattgtgttaggcaaagaattgctcatcaacatgatgatcatggagtacacaaaagagagaaagcttttagccacaataattgtggaaaagactgtgtgaaggaatcatcccagcatagcataatccaatcaggagagcaaacctctgatgaaaatggaaaaggcttaagtgttggctctaatcttgaacttcaccagcaactacacttaagagacaagcctcatgtaaatgttgagtacgggaagggcataggttacagctcagggcttcccaggcatcagtgtttccacataggagagaaatgctataggaatggtgacagtggtgagggcttcagtcagggctcacatctgcaacctcatcagagagtcagcacaggagagaacctctacagatgtcaggtatatgcccggagctccaaccagaactcctgtcttccctctcatgagcttactcacccaggagagaagttgtgtacatgtggcaggtgtgggaagggcttccatcatagcttagattttgacattcactgtgtagacagtgctggagagagagcctgtaaatgtgatgtatatgataaaggcttcagtcagacatcacaacttcaagcccatcagagaggtcactctagagacaagacatacaaatgggaagtaagtgacaggatatttaataggaattctggtcttcaccagagagttcacactggagagaaaccatataaatgtgaggtatgtgataagggcttcagtaaggcctcaaatcttcaagcccatcagagaatccacactggagagaaaccctacaaatgtgatgtgtgtgataagaacttcagccgtaattcccaccttcaggcccatcagagagtccatacaggagagaaaccctacaaatgtgacacatgtgggaaggacttcagtcagatctctcatcttcaggcccatcagagagttcacaaaggagagaagccatacaaatgtgagacatgtgggaagggctttagtcagagttcgcatctccaagaccatcagcaagtccatactggagagaatccctacaaatgtgatgtgtgtgggaaaggcttcagttggagttcacatcttcaagcccatcagagagtccacacaggagagaaaccatacaaatgtgaagaatgtaggaaaggcttcatctggaactcatatcttcatgttcatcagaggatccacacgggagagaaaccctataaatgtggcatgtgtggtaagagcttcagtcagacttcacatcttcaagcccatcagagagtccatactggagagaaaccatacaaatgttttgtgtgtggtaagggctttagtaagagttcgttgtcttcagattcatcagagagtccatgatggtgatgaatctattaatcatgatgagtgtgataggggtgctcttcaagacttagacttcccattttcctcagaaaatccacacagcacagaatatttataaaatgtcatgttttaagaattcatgagctgagtttttatagttatctgaattccattgaagaaaacctatttttgtatgaatatgaccagtttcaagcagagcccaaaatgtcacagttgtcaagagaacacacaacagagaaaccctataaagaatgatacaatatgtttcaatcagaaccttcacatccaataagcaatatgcaggagtgaagccttcaaaatgataagtaaggtcagaatttagcaaaagtataatgagggacatgacaaaatctgtgtccactagaatctaagctccatgcaggaacattgtttactgctgcatgatcgtgaccttgaacaagtacctaagaaatagtggcttccctggaattgtttaacttgataggaaaaatctatcatatataggacatatatttgaatattttagtgagctcagccccaattcgtcattataattgtactgggaaaaggattcttgcaagaagccttaaaatgaattcaaggaaatgacatttaattaaaacacat

SEQ ID NO: 201858 - DNA, 4551 bp, Homo sapiens
  Payload ID: 19822
  Gene Name: zinc finger protein 234
  Uniprot ID: Q14588
  ENST ID: ENST00000426739
  CDS Start-End: 259-2361
acattccacggtagtttcttccagttccgcgactcgcgggcccctcctaatgtcagggacttaagattggggctcgctgggacctggtggtccggttatgggaaaagaagcctcgtgggagagcagagcctgaaaaaggactgcgcggactgacttcttggctactgaaagcaaagctccactgttccaggcacgattctgccttctctcaaatggcataactcaggactctgcaaattcccagaaacaggaggaaaaatgaccacattcaaggagggactgaccttcaaggatgtggctgtggtcttcactgaggaggagctggggctgctggaccctgtccagaggaatctgtaccaagatgtgatgctggagaacttcaggaacctgctgtcagtggggcatcaccccttcaaacatgatgtattccttttagaaaaggaaaaaaagcttgatataatgaagacagcaactcaaagaaaagggaaatcagcagacaagatccaaagtgaggtggagactgttccagaagcaggacgacatgaagagctttactgggggcaaatctggaaacagattgcaagtgatttaatcaagtatgaagactctatgataagtatttctcggttccccagacaaggtgatttgtcctgccaggttagggcaggactatatacaactcacacaggacagaaattttaccaatgtgatgagtacaaaaaatccttcactgatgtcttcaactttgatcttcatcaacagttacactcaggagagaagtctcatacatgtgatgagtgtggaaaaagcttctgttacatctcagcccttcatattcatcaaagagtccacatgggagagaaatgctataagtgtgacgtgtgtggtaaggaatttagtcagagctcacatcttcaaactcatcagagagtccacactgtagagaaaccattcaaatgtgtggaatgtgggaaaggcttcagtcgtagatcaacacttactgtacattgcaaattacactcaggagagaaaccttacaattgtgaggaatgtggaagggccttcatacatgcttcccatcttcaggaacatcagagaattcatactggggagaaaccattcaaatgtgatacatgtggtaagaacttccgtcgtagatcagcacttaataatcattgcatggtccacacaggagagaaaccatacaaatgtgaggactgtggtaagtgtttcacttgtagctcaaaccttcgtatccatcaaagggtccacacaggagagaaaccttacaagtgtgaagaatgtggtaagtgctttattcagccttcacaatttcaggcccatcggagaatccacactggagagaaaccatacgtatgtaaagtgtgtggtaagggtttcatttacagttcaagttttcaggcccatcagggagtccacactggagagaagccatacaaatgcaatgagtgtgggaagagcttcagaatgaaaattcattatcaagtgcatctggtagtccacacaggggaaaaaccctataaatgtgaagtatgtggtaaagccttccgtcagagttcatatcttaaaatccatctgaaagcacatagtgtacagaaaccttttaagtgtgaagagtgtgggcagggcttcaatcagagctcacgacttcagattcaccagctgatccataccggtgagaaaccatacaaatgtgaagagtgcggaaagggatttagtcgtagagcagatcttaaaattcattgtaggatccacacaggggagaaaccatataattgtgaggagtgtgggaaggtcttcagtcaggcctcgcatcttctaacccatcagagagttcacagtggggaaaaaccatttaaatgtgaagagtgtgggaagagcttcagtcggagtgcacaccttcaagcccatcaaaaagtccacactggagaaaagccatacaaatgtggggagtgtggaaagggcttcaagtggagcttgaaccttgacatgcatcagagggtgcacacaggagaaaaaccctatacatgtggggagtgtgggaagcacttcagtcaggcctcaagtctccaacttcatcagagtgtccacacaggagagaaaccatacaaatgtgatgtatgtggtaaagtcttcagtcggtcttcacaattacagtatcataggcgagttcacactggggaaaaaccttacaaatgtgagatatgtggtaagaggttcagctggcgatcaaatcttgtaagtcatcacaaaattcatgctgctggtacattttatgaaaatgatgagaatagtaagaacatcagagagttgtcagagggaggaagttctacaaggtgattaaaaaaaaaaaaacagaactcatgtacaacctgaatgcttgtaattagatttcataggagggaaaaattttctttatcaacctctttgaatttatttgatttgtaacgctccacatttccacctagacttttttttgttttttattttttgttttgaaacagaatctcgctctgttgcccatgctggatgcagtggtgctatctcagctcactgtaacctccacttcccgggttcaagtgattctcctgcctcagtggattacaggtgcacaccaccacgcctggctaatttttgtatttttagtagagatggagtttcaccatactggccaggctggtctcaaactcctgacctcatgtgatccacccacctcggcctcccaaagtgctgggattacaggcatgagccaccgcccctggcctccatctagactttgaaatgattgccttctaattacagtagcattctcttatttaaaatatttgttttatttaagtcagtgtttaagcaatagctcagcatatcccagtggtccagtgaccacacagctgagaacccttgttaagtggtacagtaaagcattctgtcaaaactttgacatttatgacatgttacctaggaaataggacttagaaaatgagtttgacctgggctttaaaaaagtatactgatgaaggtgccagaattgatgtccattagactgtaagctccatgggggcaggaactttgctaccgaatctatacaaccttaacattgactagtgcttgtaggtgtgctcaatacttgtttgttaactgaatcaaaaggagtaaatgcacaatatttgaacattgtatccaaaggaagaaacctgcgaaataaaattatttgcagaaatgaacatttgttgaaatgcagaaaaccactggatactgcagcctacaatattaatatgatattactcttttacagttgacacctgtcctctctgtagtctcttctctcaaatttggttcttattgagagcctgtctagtttcccaaaggttttataaaacataagttgaagtacctttatttttaattttatttttgagacaggacctcgctctgtcaccgaggctggagtgcagtggcataatcatggctcactgcagcctcgtcctcccaggctccatccatctgcccatctctccctctgagtagctgggaccacgggcacgtgccaccacacccagctaatttttgtatgtttggtagagaaagggtttcaccacattgcccaggctggtcttgaacacctgagctcaagcaatccaacctccttggcctcccagtgttaaattacaggcgtaagccaccacacccggccaagttgaagtatattttgtgatttttctgacagtgcagactgaaaaaaatttaattaacctgacaagagtttactgaatatcacacaattgagtttttaatccattaatgttaaggcaggggtttactctaacacttttaaagtgtcagaagtagttgccaatgccaaatttttatcagcccccttgaatttatttgatttctgactttccacatttccatccagactttgacatgattgccgtctaataactgtagcattctcttattaaaacttctggctgggtgtggtggctcatgcctgtaaccccagcactttaggaggccaaggcaggtgaatcacctgaggtcaggacttagagaccagcctgaccaacatggtgaaaccccatctctactaaatacaaaaattagctgggcatggtggcaggcgcctgtaatcccagctactcaggaggctgaggcaggaggattgcttgaacccgggaggcggaagttgcagtgagccgagactgcgccattgcactccagcttgggtgacagagcaagactccgtctcaaaaaaaaaaaaaaaaacttctgaggtaggggctgtaccatatttttgccccacacccattaagcgaataccaaaaacaacttgtggaaatttgataattttatcaaatttattatttgggcaggattggcatttaccatgcttttccctattgctggcagtaaaacatgggtttaaggaagagtgtttttcagaatttacactgtatatctctgatttggaagttatataattggaatttatgattatgagattaaaataccaaaaagactaagtaa

SEQ ID NO: 201859 - DNA, 2292 bp, Homo sapiens
  Payload ID: 19822
  Gene Name: zinc finger protein 234
  Uniprot ID: Q14588
  ENST ID: ENST00000592437
  CDS Start-End: 190-2292
ggagtcgcgggcacttccgctccagggaagagggggcgattgtcacggcacattccacgcctgaaaaaggactgcgcggactgacttcttggctactgaaagcaaagctccactgttccaggcacgattctgccttctctcaaatggcataactcaggactctgcaaattcccagaaacaggaggaaaaatgaccacattcaaggagggactgaccttcaaggatgtggctgtggtcttcactgaggaggagctggggctgctggaccctgtccagaggaatctgtaccaagatgtgatgctggagaacttcaggaacctgctgtcagtggggcatcaccccttcaaacatgatgtattccttttagaaaaggaaaaaaagcttgatataatgaagacagcaactcaaagaaaagggaaatcagcagacaagatccaaagtgaggtggagactgttccagaagcaggacgacatgaagagctttactgggggcaaatctggaaacagattgcaagtgatttaatcaagtatgaagactctatgataagtatttctcggttccccagacaaggtgatttgtcctgccaggttagggcaggactatatacaactcacacaggacagaaattttaccaatgtgatgagtacaaaaaatccttcactgatgtcttcaactttgatcttcatcaacagttacactcaggagagaagtctcatacatgtgatgagtgtggaaaaagcttctgttacatctcagcccttcatattcatcaaagagtccacatgggagagaaatgctataagtgtgacgtgtgtggtaaggaatttagtcagagctcacatcttcaaactcatcagagagtccacactgtagagaaaccattcaaatgtgtggaatgtgggaaaggcttcagtcgtagatcaacacttactgtacattgcaaattacactcaggagagaaaccttacaattgtgaggaatgtggaagggccttcatacatgcttcccatcttcaggaacatcagagaattcatactggggagaaaccattcaaatgtgatacatgtggtaagaacttccgtcgtagatcagcacttaataatcattgcatggtccacacaggagagaaaccatacaaatgtgaggactgtggtaagtgtttcacttgtagctcaaaccttcgtatccatcaaagggtccacacaggagagaaaccttacaagtgtgaagaatgtggtaagtgctttattcagccttcacaatttcaggcccatcggagaatccacactggagagaaaccatacgtatgtaaagtgtgtggtaagggtttcatttacagttcaagttttcaggcccatcagggagtccacactggagagaagccatacaaatgcaatgagtgtgggaagagcttcagaatgaaaattcattatcaagtgcatctggtagtccacacaggggaaaaaccctataaatgtgaagtatgtggtaaagccttccgtcagagttcatatcttaaaatccatctgaaagcacatagtgtacagaaaccttttaagtgtgaagagtgtgggcagggcttcaatcagagctcacgacttcagattcaccagctgatccataccggtgagaaaccatacaaatgtgaagagtgcggaaagggatttagtcgtagagcagatcttaaaattcattgtaggatccacacaggggagaaaccatataattgtgaggagtgtgggaaggtcttcagtcaggcctcgcatcttctaacccatcagagagttcacagtggggaaaaaccatttaaatgtgaagagtgtgggaagagcttcagtcggagtgcacaccttcaagcccatcaaaaagtccacactggagaaaagccatacaaatgtggggagtgtggaaagggcttcaagtggagcttgaaccttgacatgcatcagagggtgcacacaggagaaaaaccctatacatgtggggagtgtgggaagcacttcagtcaggcctcaagtctccaacttcatcagagtgtccacacaggagagaaaccatacaaatgtgatgtatgtggtaaagtcttcagtcggtcttcacaattacagtatcataggcgagttcacactggggaaaaaccttacaaatgtgagatatgtggtaagaggttcagctggcgatcaaatcttgtaagtcatcacaaaattcatgctgctggtacattttatgaaaatgatgagaatagtaagaacatcagagagttgtcagagggaggaagttctacaaggtga

SEQ ID NO: 201860 - DNA, 663 bp, Homo sapiens
  Payload ID: 19822
  Gene Name: zinc finger protein 234
  ENST ID: ENST00000590795
  CDS Start-End: 223-384
cgggcccctcctaatgtcagggacttaagattggggctcgctgggacctggtggtccggttatgggaaaagaagcctcgtgggagagcagagcctgaaaaaggactgcgcggactgacttcttggctactgaaagcaaagctccactgttccaggcacgattctgccttctctcaaatggcataactcaggactctgcaaattcccagaaacaggaggaaaaatgaccacattcaaggagggactgaccttcaaggatgtggctgtggtcttcactgaggaggagctggggctgctggaccctgtccagaggaatctgtaccaagatgtgatgctggagaacttcaggaacctgctgtcagtgggaccaatcaggttgaagtaaagatatatagagaccggacttacagtttgaaaaaaagaaagtagagtgcccactggaacccactggagcccactgtacctatgcccacaaaaggagaagaaaccttttcctgggagcccgctgactatacagaggacaaaggcattcttatgccaggccttgctcctttatctgagcgagctggagggcatcaccccttcaaacatgatgtattccttttagaaaaggaaaaaaagcttgatataatgaagacagcaactcaaagaaaagggaaatcag

SEQ ID NO: 201861 - DNA, 3188 bp, Homo sapiens
  Payload ID: 19823
  Gene Name: zinc finger protein 235
  Uniprot ID: Q14590
  ENST ID: ENST00000291182
  CDS Start-End: 104-2320
ggaggcacttccgctccaggaaggcgaggtcggatctgagatatctcccagggaggttcacttccccggaactctgccttttcccagaaggaggaggggaaaaatgaccaagttccaggaggcagtgacattcaaggatgtggctgtggccttcactgaggaggagctggggctgctggactctgcccagaggaagctgtaccgagatgtgatgctggagaactttaggaacctggtttcagtgggacatcagtccttcaaaccagatatgatatcccagttggagagggaagaaaagctttggatgaaggagcttcaaacccaaagaggtaagcattcaggagacaggaatcaaaatgagatggcaactcttcacaaagcaggattaaggtgcttttcactgggagagctttcatgctggcaaatcaagagacacattgcgagcaaattagccagaagtcaagactccatgataaatattgaaggaaagagctctcagttccccaagcaccatgattccccctgtcaagtgggagcaggagaatctattcaagcttctgtggatgacaactgtctagtgaatcacataggggatcattccagtatcattgaaaatcaagaatttccaactgggaaagttccgaattcttggagtaaaatatatctgaatgagacacagaattatcagagaagttgtaagcagactcagatgaaaaacaaactatgtatatttgctccatatgttgacattttcagttgtatttcacaccaccatgatgataatatagtgcacaaaagagataaagttcatagcaatagtgattgtggtaaagataccctaaaggtatcacctcttacccagcgtagtattcacacaggacagaaaacctaccagggtaatgaatgtgaagaagccttcaatgatagctccagtcttgaacttcataaacaggtacacttgggaaagaagtctccagcgtgtagtacacatgagaaggacaccagttatagctcaggtattcctgttcaacaaagtgttcgtactgggaaaaaacgctattggtgtcatgaatgtggtaaaggtttcagtcagagctcaaatctgcaaactcatcagagagtccacacaggggagaaaccctatacatgccacgagtgtggtaagagctttaatcagagctcacatctttatgctcatttgcctattcacacaggagagaagccctatagatgtgacagttgtgggaagggcttcagtcgtagcacagatcttaacattcattgcagagttcacactggagagaaaccttataaatgtgaggtgtgtgggaagggcttcactcagagatcacatcttcaggcccatgaaagaattcacactggagagaaaccatataaatgtggggattgtggtaaacgctttagttgtagctcaaatcttcatacccatcagagagtccacactgaagaaaaaccatacaaatgtgatgagtgtggtaagtgctttagtttgagctttaatcttcatagtcatcaacgagtccacacaggagaaaaaccatataaatgtgaagagtgtggtaagggttttagttcagcctcaagtttccagagccatcagagggtccatacaggagagaaaccatttcgatgcaacgtgtgtgggaaaggcttcagtcagagttcatactttcaagcacatcagagagtccacactggagaaaaaccatacaaatgtgaagtgtgtgggaagcgcttcaattggagcttgaatcttcacaatcatcagagagtccacaccggagagaaaccctacaaatgtgaagagtgtggtaagggtttcagtcaggcttcaaatcttcaagcccatcagagcgtccacactggggaaaaaccattcaagtgtgatgcatgtcagaagcgattcagtcaggcctcacaccttcaagcccatcagagagtccacaccggagagaaaccatataaatgtgacacttgtggtaaggccttcagccagaggtcaaatcttcaagtccatcagataattcacactggagagaaaccatttaaatgtgaggaatgtgggaaagaattcagttggagtgctggtctcagtgcccatcagagggtccacacaggagagaaaccctatacgtgtcagcagtgtgggaagggcttcagtcaggcctcacattttcacacacaccagagagtccacactggagagaggccttacatatgtgatgtctgttgtaagggcttcagtcagaggtcacatctcatctaccatcagagagtccacactggagggaatctgtagaaatgagaggtgtggttcagccttcagttagagctcacatctttgtctccgttgggaagtccatgctgatgattgtgaaaagttcctttaaaactagaagcttcaaagaatcttgacaggaaagaagtctctcaaatgctgtgttttagacttggttaggacatgaattctttacaaacgtcatatttcacagatgcgagaaaactttgttctgtaaatatgatcagtgtttatatcagagtaccaggtgtcccggttctcaagatgtaacacagcagaaaagtcttgtcggagtctgcacaggagagaggccttcctttaacaaaagtatgattgacagaaaaaatggatgtcaactaaaatgtaacctctatgtaaggaggtgtttttcaccactctatctctaccatgtagaattgtgcttggctcataatagggcccagcaattactgaagaaagtgaagaaaatacctataattaggacaaatacttgaaaattctagtctgttttctactctaaatttatattaatttatattcaaaaggaatcctgcaagtagccttaataacgttagtttcagtaagtactgaaaagtatataatactgccatccatactaacacaaatttggaaaaaagacatgaatggctcccatccttcagccttagttctttgtacagtgtatcatcagttgtgtacagtatgatttttagtgtcagtttatagactgaacaatactgtttttatctaatgtgaccctgcaatttacatgattagaatttttggacactaagctgtactgtaactctgaaagtgttaaaagtagttactgatgacaaaaagtttcttagtaaacttgaattgttaa

SEQ ID NO: 201862 - DNA, 616 bp, Homo sapiens
  Payload ID: 19823
  Gene Name: zinc finger protein 235
  ENST ID: ENST00000592844
  CDS Start-End: 29-274
gccttttcccagaaggaggaggggaaaaatgaccaagttccaggaggcagtgacattcaaggatgtggctgtggccttcactgaggaggagctggggctgctggactctgcccagaggaagctgtaccgagatgtgatgctggagaactttaggaacctggtttcagtgggacatcagtccttcaaaccagatatgatatcccagttggagagggaagaaaagctttggatgaaggagcttcaaacccaaagaggtaagcattcagaaacctgaatagagtcaccttgtaataactgggaactcttcccctgaagacacctggttaattcacttgcaacctgtttccagatttgccagcaggacagctcttgatttgaaagggttttgcaactgcagcactactattttggactggccaattctctgttgggggcactgtcctgtgcactgtaggagattttgcagaattcctggatactacccacaaaatgccaatagcacccctctgtcaggtgtgacaaccatttccagacattgccaaatatcttctgggggcgaaatcacccatggttgagaaccagcaatttaaaaggacagaattttgcctgagcagaa

SEQ ID NO: 201863 - DNA, 946 bp, Homo sapiens
  Payload ID: 19823
  Gene Name: zinc finger protein 235
  ENST ID: ENST00000591609
  CDS Start-End: 62-946
gagtcagctccgggtctccaagacttctccgagccctctttgcctaggcgtggggccagcaatgaacccgtccttggcttggggaagagaagccgcggccagcgctggagggcggggttgggaggctgcgggagtttgcgtcccctcggcagaacctcttgcgtgggaggcgggctcgcgtcgtccttcgaggttgagggtctgctgccctagccgtcctcacgcacctaccagccagtcctgcctgctcctcgcagtaaaatattgggttcacttccccggaactctgccttttcccagaaggaggaggggaaaaatgaccaagttccaggaggcagtgacattcaaggatgtggctgtggccttcactgaggaggagctggggctgctggactctgcccagaggaagctgtaccgagatgtgatgctggagaactttaggaacctggtttcagtgggacatcagtccttcaaaccagatatgatatcccagttggagagggaagaaaagctttggatgaaggagcttcaaacccaaagaggtaagcattcaggagacaggaatcaaaatgagatggcaactcttcacaaagcaggattaaggtgcttttcactgggagagctttcatgctggcaaatcaagagacacattgcgagcaaattagccagaagtcaagactccatgataaatattgaaggaaagagctctcagttccccaagcaccatgattccccctgtcaagtgggagcaggagaatctattcaagcttctgtggatgacaactgtctagtgaatcacataggggatcattccagtatcattgaaaatcaagaatttccaactgggaaagttccgaattcttggagtaaaatatatctgaatgagacacagaattatcagagaagttgtaagcagactcagatgaaaaacaaactatgtatattt

SEQ ID NO: 201864 - DNA, 532 bp, Homo sapiens
  Payload ID: 19823
  Gene Name: zinc finger protein 235
  ENST ID: ENST00000589248
  CDS Start-End: 125-388
gtccacgaaccgtgggcactcggaggcacttccgctccaggaaggcgaggtcggatctgagatatctcccagggaggttcacttccccggaactctgccttttcccagaaggaggaggggaaaaatgaccaagttccaggaggcagtgacattcaaggatgtggctgtggccttcactgaggaggagctggggctgctggactctgcccagaggaagctgtaccgagatgtgatgctggagaactttaggaacctggtttcagtgggacatcagtccttcaaaccagatatgatatcccagttggagagggaagaaaagctttggatgaaggagcttcaaacccaaagaggtaagcattcagggtttctctgttgtgtgttctcttgacaactgtgacattttgggctctgcttgaaactggtcatattcatacaaaaataggttttcttcaatggaattcagataactataaaaactcagctcatgaattcttaaaacatgacattttataaatattctgtgctgtgtgga

SEQ ID NO: 201865 - DNA, 955 bp, Homo sapiens
  Payload ID: 19823
  Gene Name: zinc finger protein 235
  ENST ID: ENST00000589799
  CDS Start-End: 98-349
acttccgctccaggaaggcgaggtcggatctgagatatctcccagggaggttcacttccccggaactctgccttttcccagaaggaggaggggaaaaatgaccaagttccaggaggcagtgacattcaaggatgtggctgtggccttcactgaggaggagctggggctgctggactctgcccagaggaagctgtaccgagatgtgatgctggagaactttaggaacctggtttcagtgggacatcagtccttcaaaccagatatgatatcccagttggagagggaagaaaagctttggatgaaggagcttcaaacccaaagaggtaagcattcagtgtggactctctgatgggcttcaagacgtgcactctgactgaagcctttaccacactcttcacatttaaagagtttttccctggtgtgaacacccaggtggactcgaagatttgaggggagactgaaggccttaccacactcctcacatatatggggtttctctcccgtgtggaccctctgatgatggcgaagattcaagctcctaccaaagcctttcccacactcttcacatttgtaaggtttttctccagtgtggcctctctgatggtatataaactgcgaactgtatctaaagccctttccacacacatcacatttgtatggcttttcccccgtgtggactctctgatgggattgaagaccagaggactgactgaagcccttaccacagacaccacatttgtatggcttctctccagtatggactctctgatgtacccgaaaatctatggcctgactgaagctcttatcacactgctcacatttatagggtttttctcctgagtgaactctttgatgtgcatgaagatttgatctccaactgaagcccttcccacattcctcacatttatatggtttttctccagtgtgaattacttggtgtagtttaagatttgaa

SEQ ID NO: 201866 - DNA, 1764 bp, Homo sapiens
  Payload ID: 19823
  Gene Name: zinc finger protein 235
  ENST ID: ENST00000616224
  CDS Start-End: 1-1764
tcaggagacaggaatcaaaatgagatggcaactcttcacaaagcaggattaaggtgcttttcactgggagagctttcatgctggcaaatcaagagacacattgcgagcaaattagccagaagtcaagactccatgataaatattgaaggaaagagctctcagttccccaagcaccatgattccccctgtcaagtgggagcaggagaatctattcaagcttctgtggatgacaactgtctagtgaatcacataggggatcattccagtatcattgaaaatcaagaatttccaactgggaaagttccgaattcttggagtaaaatatatctgaatgagacacagaattatcagagaagttgtaagcagactcagatgaaaaacaaactatgtatatttgctccatatgttgacattttcagttgtatttcacaccaccatgatgataatatagtgcacaaaagagataaagttcatagcaatagtgattgtggtaaagataccctaaaggtatcacctcttacccagcgtagtattcacacaggacagaaaacctaccagggtaatgaatgtgaagaagccttcaatgatagctccagtcttgaacttcataaacaggtacacttgggaaagaagtctccagcgtgtagtacacatgagaaggacaccagttatagctcaggtattcctgttcaacaaagtgttcgtactgggaaaaaacgctattggtgtcatgaatgtggtaaaggtttcagtcagagctcaaatctgcaaactcatcagagagtccacacaggggagaaaccctatacatgccacgagtgtggtaagagctttaatcagagctcacatctttatgctcatttgcctattcacacaggagagaagccctatagatgtgacagttgtgggaagggcttcagtcgtagcacagatcttaacattcattgcagagttcacactggagagaaaccttataaatgtgaggtgtgtgggaagggcttcactcagagatcacatcttcaggcccatgaaagaattcacactggagagaaaccatataaatctcaaatcttcatacccatcagagactttaatcttcatagtcatcaacgagtccacacaggagaaaaaccatataaatgtgaagagtgtggtaagggttttagttcagcctcaagtttccagagccatcagagggtccatacaggagagaaaccatttcgatgcaacgtgtgtgggaaaggcttcagtcagagttcatactttcaagcacatcagagagtccacactggagaaaaaccatacaaatgtgaagtgtgtgggaagcgcttcaattggagcttgaatcttcacaatcatcagagagtccacaccggagagaaaccctacaaatgtgaagagtgtggtaagggtttcagtcaggcttcaaatcttcaagcccatcagagcgtccacactggggaaaaaccattcaagtgtgatgcatgtcagaagcgattcagtcaggcctcacaccttcaagcccatcagagagtccacaccggagagaaaccatataaatgtgacacttgtggtaaggccttcagccagaggtcaaatcttcaagtccatcagataattcacactggagagaaaccatttaaatgtgaggaatgtgggaaagaattcagttggagtgctggtctcagtgcccatcagagggtccacacaggagagaaaccctatacgtgtcagcagtgtgggaagggcttcagtcaggcctca

SEQ ID NO: 201867 - DNA, 8124 bp, Homo sapiens
  Payload ID: 19824
  Gene Name: zinc finger protein 236
  Uniprot ID: Q9UL36
  ENST ID: ENST00000253159
  CDS Start-End: 199-5736
gcctggaaactacaaaggattgtgttaattttgtgtttaggaagaaagaggtaatgggtaggaatcaatgtaaacttattcataggccacaccaaaccaggaattcttgtcgtgattgcacttggtagagttaacacacgtgcacattacggaaacgttggtgaccaacaggcgtttcagcgagctttcgcacacctcatgggcctttgtgggctgctggagagatgttggctgcaccatgacccagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatattccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccgaacttaacactacaagcggaagccttccttcaacaacaccgatgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcagggtcagcagttcccagcgctcctcacggatccctctctctcgggccagggtggagcaggctcgccgcaagtcatactagtgagccacacgccacagtcagcgtctgctgcttgtgaagaaatagcctaccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggagcacatgcagacacaccaggccggcccctctttgagctcccagaagccaagagtgtttaaatgtgacacttgtgagaaggcatttgccaaaccaagccagctggagcgccacagccgcatacatacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggagctctgcaggagtctgcaggtcacccggagcaggacggggaggagctgagccggaccctccacctggaggaggtggtgcaggaggccgccggcgagtggcaggccctcacccacgtcttctgatgcgagttggaagtacacctttaagaatgtttctgaagttacgttttgtgaagagcaaagcacttggaatctccgttttaaagcttcaagtgttaaaaatgctacaatagttttttatctataaaattatctaaagaatcattgtctttcagagactcataggaaaaaaaaactaggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacattgaaaaagtatgtcagattttccttcatgtttctggttataagaagcatagcttacaaagcaagcgtaagattgaggcatgaagttcagaaaaaaaagtgttacaacacacagggaagttttttccactcttttctctgtgcattttgaaaattagtcaaaatggactcttttcagtctaccataagttaatataactgataccttgagagatggctggaccaattctctccatgacaaatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggacatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttaggaaa

SEQ ID NO: 201868 - DNA, 7124 bp, Homo sapiens
  Payload ID: 19824
  Gene Name: zinc finger protein 236
  ENST ID: ENST00000320610
  CDS Start-End: 2-5545
gatgccgcggggccgccccccgaagcccagggagagcaaggcgcgcggcgactccgatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatattccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccgaacttaacactacaagcggaagccttccttcaacaacaccgatgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcagggtcagcagttcccagcgctcctcacggatccctctctctcgggccagggtggagcaggctcgccgcaagtcatactagtgagccacacgccacagtcagcgtctgctgcttgtgaagaaatagcctaccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggagcacatgcagacacaccaggccggcccctctttgagctcccagaagccaagagtgtttaaatgtgacacttgtgagaaggcatttgccaaaccaagccagctggagcgccacagccgcatacatacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggagctctgcaggagtctgcaggtcacccggagcaggacggggaggagctgagccggaccctccacctggaggaggtggtgcaggaggccgccggcgagtggcaggccctcacccacgtcttctgatgcgagttggaagtacacctttaagaatgtttctgaagttacgttttgtgaagagcaaagcacttggaatctccgttttaaagcttcaagtgttaaaaatgctacaatagttttttatctataaaattatctaaagaatcattgtctttcagagactcataggaaaaaaaaactaggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacattgaaaaagtatgtcagattttccttcatgtttctggttataagaagcatagcttacaaagcaagcgtaagattgaggcatgaagttcagaaaaaaaagtgttacaacacacagggaagttttttccactcttttctctgtgcattttgaaaattagtcaaaatggactcttttcagtctaccataagttaatataactgataccttgagagatggctggaccaattctctccatgacaaatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaa

SEQ ID NO: 201869 - DNA, 8206 bp, Homo sapiens
  Payload ID: 19824
  Gene Name: zinc finger protein 236
  Uniprot ID: Q9UL36
  ENST ID: ENST00000543926
  CDS Start-End: 199-4875
gcctggaaactacaaaggattgtgttaattttgtgtttaggaagaaagaggtaatgggtaggaatcaatgtaaacttattcataggccacaccaaaccaggaattcttgtcgtgattgcacttggtagagttaacacacgtgcacattacggaaacgttggtgaccaacaggcgtttcagcgagctttcgcacacctcatgggcctttgtgggctgctggagagatgttggctgcaccatgacccagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatattccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccggttccaggtctgtgcagcacagtgtgggaccccaggagtgtggatctgtggaggcattgtatttggagaactccagcgacaaaacttaacactacaagcggaagccttccttcaacaacaccgatgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcagggtcagcagttcccagcgctcctcacggatccctctctctcgggccagggtggagcaggctcgccgcaagtcatactagtgagccacacgccacagtcagcgtctgctgcttgtgaagaaatagcctaccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggagcacatgcagacacaccaggccggcccctctttgagctcccagaagccaagagtgtttaaatgtgacacttgtgagaaggcatttgccaaaccaagccagctggagcgccacagccgcatacatacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggagctctgcaggagtctgcaggtcacccggagcaggacggggaggagctgagccggaccctccacctggaggaggtggtgcaggaggccgccggcgagtggcaggccctcacccacgtcttctgatgcgagttggaagtacacctttaagaatgtttctgaagttacgttttgtgaagagcaaagcacttggaatctccgttttaaagcttcaagtgttaaaaatgctacaatagttttttatctataaaattatctaaagaatcattgtctttcagagactcataggaaaaaaaaactaggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacattgaaaaagtatgtcagattttccttcatgtttctggttataagaagcatagcttacaaagcaagcgtaagattgaggcatgaagttcagaaaaaaaagtgttacaacacacagggaagttttttccactcttttctctgtgcattttgaaaattagtcaaaatggactcttttcagtctaccataagttaatataactgataccttgagagatggctggaccaattctctccatgacaaatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggacatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttaggaaa

SEQ ID NO: 201870 - DNA, 1659 bp, Homo sapiens
  Payload ID: 19824
  Gene Name: zinc finger protein 236
  ENST ID: ENST00000579322
  CDS Start-End: 279-1659
cacatggtttaagaagcatcattatggcttttgtgtgttttggtgtgtgtggctgtgaagcctcaggaatttagtttaagcttctgaaaagcccaccaatatgtatttagaattctgttgtcccatatcttagtcatctcaatgtttctcatttctaactttaaaacatgtcaattaaaaaaattcagtatatcattaatttcgtctaaaatgtcacataaatctctgacataatttggtttttaaacaataaccaataatttggttttatttatgtgatgagaataacaactggtatttattgtctatacttatgcaattttatagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaa

SEQ ID NO: 201871 - DNA, 2389 bp, Homo sapiens
  Payload ID: 19825
  Gene Name: zinc finger protein 239
  Uniprot ID: Q16600
  ENST ID: ENST00000306006
  CDS Start-End: 654-2030
ctagtcccgattatggttattacagtttgatgaaatgtggctgagatcattggcactgtggagattaagaaatgtgaggtcagagtgttgggtaaattgttcctgcgagtgttaaggttgtcaggataatggtgggaatggggtgaagatgacaactcagcaatgacacaagaagagagtgacacagaaagattcagtagctgagaacttgagcgtagatatgttgtgggcaggagggaaatgatttggatggaagtagccaagtaagtgagaaaggaaagactttccaacaaaacttggcttagctcactcagatccctgagctgcaaacttcttctatacctttcttaccttttccagtgctgctgacttcaccccacttgcagggcatttgtgcagatggttgtttgttgaggaggaatgtgcttaatgttttaggaaccagttacattcaaggatgcctctgtggccttcaccgaggaggagtgaggtcacctggactctgctcccaggaagctgtgcggagctgtgatgctgggcaactacagaaacttggtcttggagacttgaatgaaaattctgtggagaatcttcagcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcgaaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagagctcatacagaggagaaaccctgtgaccataataactgtgggaaaatacttaacaccagcccagatggtcatccatatgagaaaatccacactgcagagaaacaatacgaatgtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgacaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccctatgagtgtgaggagtgtggtatgagcttcagtcagcgctcaaacctgcacatccaccagcgagtacacacaggagagaggccctacaagtgtggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacatgttctacccagcattttaacggcaagaactttatatttattctcaagcagggcatgtttccctttgttcacattctctgagaaattgaaactctggtttctcttcaaa

SEQ ID NO: 201872 - DNA, 2037 bp, Homo sapiens
  Payload ID: 19825
  Gene Name: zinc finger protein 239
  Uniprot ID: Q16600
  ENST ID: ENST00000374446
  CDS Start-End: 302-1678
gcatccggaatctggcccctgcaggcgtggggttccacgtgggaggaatccatcccctctgggagtaagaaatgaccagggtccgggaaccagttacattcaaggatgcctctgtggccttcaccgaggaggagtgaggtcacctggactctgctcccaggaagctgtgcggagctgtgatgctgggcaactacagaaacttggtcttggagacttgaatgaaaattctgtggagaatcttcagcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcgaaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagagctcatacagaggagaaaccctgtgaccataataactgtgggaaaatacttaacaccagcccagatggtcatccatatgagaaaatccacactgcagagaaacaatacgaatgtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgacaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccctatgagtgtgaggagtgtggtatgagcttcagtcagcgctcaaacctgcacatccaccagcgagtacacacaggagagaggccctacaagtgtggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacatgttctacccagcattttaacggcaagaactttatatttattctcaagcagggcatgtttccctttgttcacattctctgagaaattgaaactctggtttctcttcaaa

SEQ ID NO: 201873 - DNA, 2027 bp, Homo sapiens
  Payload ID: 19825
  Gene Name: zinc finger protein 239
  Uniprot ID: Q16600
  ENST ID: ENST00000426961
  CDS Start-End: 295-1671
ttgtatttcggggccctaggcgcgcgagcggtcagcatccggaatctggcccctgcaggcgtggggttccacgtgggaggaaccagttacattcaaggatgcctctgtggccttcaccgaggaggagtgaggtcacctggactctgctcccaggaagctgtgcggagctgtgatgctgggcaactacagaaacttggtcttggagacttgaatgaaaattctgtggagaatcttcagcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcgaaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagagctcatacagaggagaaaccctgtgaccataataactgtgggaaaatacttaacaccagcccagatggtcatccatatgagaaaatccacactgcagagaaacaatacgaatgtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgacaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccctatgagtgtgaggagtgtggtatgagcttcagtcagcgctcaaacctgcacatccaccagcgagtacacacaggagagaggccctacaagtgtggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacatgttctacccagcattttaacggcaagaactttatatttattctcaagcagggcatgtttccctttgttcacattctctgagaaattgaaactctggtttctcttc

SEQ ID NO: 201874 - DNA, 1904 bp, Homo sapiens
  Payload ID: 19825
  Gene Name: zinc finger protein 239
  Uniprot ID: Q16600
  ENST ID: ENST00000535642
  CDS Start-End: 172-1548
ttgtatttcggggccctaggcgcgcgagcggtcagcatccggaatctggcccctgcaggcgtggggttccacgtgggaggagacttgaatgaaaattctgtggagaatcttcagcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcgaaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagagctcatacagaggagaaaccctgtgaccataataactgtgggaaaatacttaacaccagcccagatggtcatccatatgagaaaatccacactgcagagaaacaatacgaatgtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgacaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccctatgagtgtgaggagtgtggtatgagcttcagtcagcgctcaaacctgcacatccaccagcgagtacacacaggagagaggccctacaagtgtggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacatgttctacccagcattttaacggcaagaactttatatttattctcaagcagggcatgtttccctttgttcacattctctgagaaattgaaactctggtttctcttc

SEQ ID NO: 201875 - DNA, 6307 bp, Homo sapiens
  Payload ID: 19826
  Gene Name: zinc finger protein 24
  Uniprot ID: P17028
  ENST ID: ENST00000261332
  CDS Start-End: 181-1287
gcgccgggggcttctgggaaaaggcttgtgaacggcgtttctgcgtctgccgtggacagcgaagctgctgcggttcctgagccggaggtttgcgccggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgatgatgatggtaggactgaaaatggagcactagctccaaagcaggagcttccttcagcattagaatcccatgaagttcctggcactctcaatatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaaacattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaaatggaaggtgagattttgcatgagcctattaaaaagcatagtaataaatgcaaggccagctggtggaaaagtgaggcagaatggagcttgtttataggttttctgataacaattataaaaaatgtgctttatagattaagatttattgaagtataaatatgtagtaatgatataatgtattttaagttatacaagaaaatgtagggacttttgtttgggtctttttctctttgtggctgaggggaaacaagtcagtgtccaataaagctgtaaactcctctgctctaagataaatgatgtgatttatttatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagtgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaagataattgaattgagtttctgttctgattaatataggttatttgtattttcttattgatttgtagaaaacctttgtaattttaaattctagactttatgcactatataagttaataaaattagcatggccttccatgatttggcctgtgtcaa

SEQ ID NO: 201876 - DNA, 6282 bp, Homo sapiens
  Payload ID: 19826
  Gene Name: zinc finger protein 24
  Uniprot ID: P17028
  ENST ID: ENST00000399061
  CDS Start-End: 171-1277
gcgccgggggcttctgggaaaaggcttgtgaacggcgtttctgcgtctgccgtggacagcgaagctgctgcggttcctgagccggaggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgatgatgatggtaggactgaaaatggagcactagctccaaagcaggagcttccttcagcattagaatcccatgaagttcctggcactctcaatatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaaacattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaaatggaaggtgagattttgcatgagcctattaaaaagcatagtaataaatgcaaggccagctggtggaaaagtgaggcagaatggagcttgtttataggttttctgataacaattataaaaaatgtgctttatagattaagatttattgaagtataaatatgtagtaatgatataatgtattttaagttatacaagaaaatgtagggacttttgtttgggtctttttctctttgtggctgaggggaaacaagtcagtgtccaataaagctgtaaactcctctgctctaagataaatgatgtgatttatttatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagtgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaagataattgaattgagtttctgttctgattaatataggttatttgtattttcttattgatttgtagaaaacctttgtaattttaaattctagactttatgcactatataagttaataaaattagcatggccttccatga

SEQ ID NO: 201877 - DNA, 756 bp, Homo sapiens
  Payload ID: 19826
  Gene Name: zinc finger protein 24
  ENST ID: ENST00000590140
  CDS Start-End: 341-756
caggatctaggatgggatactgtggtgagcaagacagacaaggtccctgcccttaagggacttaaagacaaaacaaaacaaaaaataaaacaagtaaataaatgagatcacttccattaataacagtgccatgaagggtcatgcgccatgaaaggcaggtggtgaggctgaggatcttgggccacaatgagccgaggagctgaggggattactgagaggatccacaagataatgcacgtgaaagggcttgcgaaattgagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggaca

SEQ ID NO: 201878 - DNA, 578 bp, Homo sapiens
  Payload ID: 19826
  Gene Name: zinc finger protein 24
  ENST ID: ENST00000589539
  CDS Start-End: 273-578
tttggtcatctgaaatccgcggtcctgagtgctgggaagaggggctagaggacgtcgggccggggccggggccggggccgggatacacagcaggtctatgcagcagtaaggtgggcgatccacctgggacgaggtaccctgcccaaacattgtcgggaccgtgggccttccctccatttcccacaagcggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgcc

SEQ ID NO: 201879 - DNA, 7419 bp, Homo sapiens
  Payload ID: 19826
  Gene Name: zinc finger protein 24
  Uniprot ID: P17028
  ENST ID: ENST00000589881
  CDS Start-End: 5-586
cagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgtaatcattccttgaagtagttggagatggtgctggtatgccactgaatgaggtctgagcaggttttcttcacatctgaggggacagtgccagccagtcaacttttggggtggggctgaagtctgctgaaaatctgcagttttacatgtttcatgggacattcttctgtgcaataaagtttgagaagtatcattcttgatatatggggctgatattttcaacttctcatcatctgaattttagagtgacttttcacctgcgttccttatttcagctgtctagtctcttccacacttgggaatttctgtttcctgtgtgccgtttgtctccacttaatcttcacgctcctctgtttttcaagtctccaagcctcactatcctcctctaacctttcagtctctctctcttagccttatctcctgacttgatctttttgttaattatttactgttttcctcttcgctgaaggcagttgctaaccctatatgaactggatctttactccttaaggcatgaagttttagaaaagtcttaaatgacacttgctgttatctctgcctgcgtgtgagtgatgctaacccatgttggtaattcaggcttttctttcattggacacgtttcactgaggcttagaaataacgatttttctaagtaccatgacaaataccacatgggagaagctgcttttattggaaaactttcatttattaggggcatactgaatttttatgtcatgtctttggttaacacaggaggcccccagcttatcttcagccccttcttgtcaagactcctgtgttctgcttttaggctaacattggctgtgacctgacttggcttgttcatttcagaaatagccactttctgacatgtttttctaatttacatctttgtattttgatgtaatttctccctttctcaaagtaaaagaacattataatgatttcctagtggccaattttattttatttttattcttacaaagtttcatccatacctagccacatcattttgactatctccctaaccatcttagaatctaccatctttctgacctttgttttctgactaccatttgtaaaccacttgcctatgttttattcagatatcccttatatcatgatgttatactgttattcagagtaatttcattttttcttttttgagaataggccttaacaccagtgtcagagtggtttatagatgtgtgctagctattttagttcattaaaaaaaaaattttttttaggtttcttttcccttaatagataatgaatgatatttacattttctgtttatttcagatgatgatggtaggactgaaaatggagcactagctccaaagcaggagcttccttcagcattagaatcccatgaagttcctggcactctcaatatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaaacattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaaatggaaggtgagattttgcatgagcctattaaaaagcatagtaataaatgcaaggccagctggtggaaaagtgaggcagaatggagcttgtttataggttttctgataacaattataaaaaatgtgctttatagattaagatttattgaagtataaatatgtagtaatgatataatgtattttaagttatacaagaaaatgtagggacttttgtttgggtctttttctctttgtggctgaggggaaacaagtcagtgtccaataaagctgtaaactcctctgctctaagataaatgatgtgatttatttatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagtgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaagataattgaattgagtttctgttctgattaatataggttatttgtattttcttattgatttgtagaaaacctttgtaattttaaattctagactttatgcactatataagttaataaaattagcatggccttccatga

SEQ ID NO: 201880 - DNA, 569 bp, Homo sapiens
  Payload ID: 19826
  Gene Name: zinc finger protein 24
  ENST ID: ENST00000593130
  CDS Start-End: 282-569
aggctacaaaccggtacggcatgttgctgtactgaatactgtagagaattgtaacacaatgctaactatttgtgtatcaaaacatagaaaagataagagtaaaatatgatataaaatgtttgaaaaaaaaaaaagatatgcctgtacagggcacttaccatgaatggacctcgctggattggaagttgctctaagaagtcatgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtg

SEQ ID NO: 201881 - DNA, 4795 bp, Homo sapiens
  Payload ID: 19827
  Gene Name: zinc finger protein 248
  Uniprot ID: Q8NDW4
  ENST ID: ENST00000357328
  CDS Start-End: 206-1945
gctccaggcgagtccttccctggactccagtcccttgtgggaaacaatccctcgcctccggaggcggcgaggagcggcggaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacagtaagtgtagaaaatggagatagaggaagcaaaactttcaatttgggcacagaccctgtttctttaagaaattatccctataaaatatgtgactcatgtgaaatgaatttgaaaaatatttcgggcttaattattagtaaaaagaactgttccagaaagaagcctgatgagtttaatgtatgtgagaaattgctccttgatattaggcatgagaaaatccctattggagagaagtcttataaatatgatcaaaaaaggaatgccattaattatcaccaggatctcagtcagccaagttttggccaatcttttgagtatagtaaaaatggacaaggcttccatgatgaggcagcattttttacaaataagagatctcagataggagagacagtctgtaaatataacgaatgtggaagaaccttcattgaaagtttaaagctgaatatatctcaaagacctcatttggaaatggagccgtatggatgcagtatttgcgggaagtccttctgcatgaatttaaggtttggacatcagagagctcttacaaaggacaatccttatgaatataatgaatatggggaaatcttctgtgacaattcagctttcattatccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagcaagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgtgtgaagtcaaacctcactgaacatcagagaacacacacaggggagaagccctatgaatgtaatgcatgtgggaaatccttctgccacagatcagccctcactgtgcatcagagaacacacacaggggagaaaccgtttatatgtaatgaatgtggaaaatccttctgtgtgaagtcaaacctcattgtacatcaaagaactcacactggggagaaaccatataagtgtaatgaatgtgggaaaaccttctgtgaaaaatcagctctcactaaacatcagaggactcacacaggggagaagccgtatgagtgtaatgcatgtgggaagacctttagtcagaggtcagtgctcaccaaacatcagagaattcacacaagggtgaaagctctttcaacatcctgaatgttagaagccttcatacacttgtgaaattggttatacagtttcaaaaaaggagatcagagaaagccaaagaatgtcagaaatttgtagaaaatgacttcttgtttgaatatgtaaaagctttcaagaaaaattaaaacttttcattagaaaatttgtactgaggggaattctattcatctaagtaatatggtgaaaatatttatctggaatttatgttgtttagtgttatattccagacgtgataccaaaattttgttgcaaatataatggacaatatttatttatacccatattcacagtggaatctgaagcttataaaagttgaatgacagcagcattaaacatatatgtgaagagtccccgatgtttgtagaccttatgtgagtatgcaaatatataaatttgagtatgcttgatttgtatattggaactcaacatgatcataaggagaagatacgtacccttaattgagtaactactatggtatttgttaatattttctacactaaataccattggtgtctttataggttgacataattatatatgtgtatgtacatatgtttgtgtgtatatgtaaatatatttctacacacatacttaaatatagtgatgtgctagtataacctcatactgacttaaaagttctgattgttaaattttaaggaattttgtgagccagttattaaaagcagtcattatttaaaatatgtaaacttacagttaaaaacaaaggtaataaatactcagcactcatcacttcctaattattttgctacatttcactattacctttgctgttttacttatttaatctgtatgatgaaaatactgtataatagtgtgcactgcacatctgtctcttcccagctccacattcagtgctgtcttggtagcttggacttagtgggagtgtttacaccatggaaattgacaaactataaatcagggttttaattttctcagagaacctgctgtcaaatatttacagcacatcactgtgtatatatgaaaacgtatttggcaatacaaaccacataccccttctatttcctgacataaataaatggctatggccatttacagctgaaccacgtcttcaagaaagaagccaaaaatatttccgtgaggtttttaactacctctgaatctgtcctactctaaatactaccggagtctctttgtaggttggccagtatatgtttttagtgaaatattatttcacaaagaactatatcacgtacctttcctctgactgtttcctggcatatatgcatgaatatggccattattgaactatcacttcagtaaagaagttaaacagtacttttctgaggtttttcagctacctctgggtcattctgtaatgtaaatgttgttaataagaatggtttttacataaattatgcaaaggttaacaagcagtaacactgcactcctcaaaaagtggcggtatgtaatgaaaggcccttttgatatccttgatttttcattgtgtatctgtttgggcacggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaaattttatatttttgtgcatccttctcccagatgacttaggtggtaagtccagattagtcaaagctaatcatggaagttccattttaatgattctgttggggtgaacttgggagcaatgagatgtttgggaagtattgtgtagtacttctgggaaagatctccttgatacaacattgtcatgacatgagaagagactctgctgggctttttcatgtctgtaacatggtattggcttatcgtttttatctctgaagggcagtagcctgaagataacagtgcacaaggtgggaaaagccagctcagaggtgacgttgccgagctactctgctctctatacctgttctctactgggactttttataaccctcaataactgttttttatttggtcttagggctgtctgatacttagagctgaaggcattccagctgacacagaggaatatttttctaagtgttaatgttctatatggtaattagggggaagaattatttcttttcacaagttaatatagggatggctgtttgtatcagccatggttctttctggtggaaaacagaattctccaactaaaaatattttaatggcagactgattacagtggtgtgggccagaaacaagggacagtgaaacacccagagacttgtatcagcaggaagccattgccattctgagccttgaagggcaaggagggaaacagtgttaccagagcccagtaagaactgctgtcatgaaggaggggccaccttgtaagagacatcattactaccagaactgtggtgccaaattgctggtgtctctctttggagaaaccaaccagatacatctgctggagagcccaggtgggcacagagaagggtggagagagaatctgggaagagaaatggagaataagcagcacagtgttattcatttctgtaaattcctatgtagaaggctcagtgttagaaataaagttattctactagttgcaagttaagtgtttctgtttgttctgctttcctgttagcataagtaaactccctttggaactacacaggtatgtctctccttcaacatgtgtgaagcagacattatattaaattacattattcatacctccctgtggtgtttcttattgtatgtggtgtaaggtaagcagctctgtattcttccaaataaatagccagttgtccctg

SEQ ID NO: 201882 - DNA, 1286 bp, Homo sapiens
  Payload ID: 19827
  Gene Name: zinc finger protein 248
  Uniprot ID: Q8NDW4
  ENST ID: ENST00000374648
  CDS Start-End: 500-859
caattatccacgggagactcggttttcctctctgtaaattacggatattaggaatacttgccgcctggggttgttttgagcactttcattgtttaggtgctgtatttattgggtgtgcgttccctgggagagcccgagggagacggctcctgcaccggccccaagggcctctctgcccgtggagtgcaggagcgaaggggctggcctagctgaccaccagggcccctgctggctctgaccgccctcctatcccaagtaattatttacacgtttcgcgttcgcttatgtattatgtgtaatcatggcacagtatcctgaagccgtcggagtctgtgtgctggtgcaaggtctgggacaaatttaagaagagagagaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacatggaatctgaagcttataaaagttgaatgacagcagcattaaacatatatgtgaagagtccccgatgtttgtagaccttatgtgagtatgcaaatatataaatttgagtatgcttgatttgtatattggaactcaacatgatcataaggagaagatacgtacccttaattgagtaactactatggtatttgttaatattttctacactaaataccattggtgtctttataggttgacataattatatatgtgtatgtacatatgtttgtgtgtatatgtaaatatatttctacacacatacttaaatatagtgatgtgctagtataacctcatactgacttaaaagttctgattgttaaattttaaggaattttgtgagccagttattaaaagcagtcattatttaaaatatgtaaacttacagttaaaaacaaaggtaataaatactcagcactca

SEQ ID NO: 201883 - DNA, 5141 bp, Homo sapiens
  Payload ID: 19827
  Gene Name: zinc finger protein 248
  Uniprot ID: Q8NDW4
  ENST ID: ENST00000395867
  CDS Start-End: 552-2291
ggggctgcgggggagagcgactgcgccaggtccgcgacaaatgaattagacacaattatccacgggagactcggttttcctctctgtaaattacggatattaggaatacttgccgcctggggttgttttgagcactttcattgtttaggtgctgtatttattgggtgtgcgttccctgggagagcccgagggagacggctcctgcaccggccccaagggcctctctgcccgtggagtgcaggagcgaaggggctggcctagctgaccaccagggcccctgctggctctgaccgccctcctatcccaagtaattatttacacgtttcgcgttcgcttatgtattatgtgtaatcatggcacagtatcctgaagccgtcggagtctgtgtgctggtgcaaggtctgggacaaatttaagaagagagagaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacagtaagtgtagaaaatggagatagaggaagcaaaactttcaatttgggcacagaccctgtttctttaagaaattatccctataaaatatgtgactcatgtgaaatgaatttgaaaaatatttcgggcttaattattagtaaaaagaactgttccagaaagaagcctgatgagtttaatgtatgtgagaaattgctccttgatattaggcatgagaaaatccctattggagagaagtcttataaatatgatcaaaaaaggaatgccattaattatcaccaggatctcagtcagccaagttttggccaatcttttgagtatagtaaaaatggacaaggcttccatgatgaggcagcattttttacaaataagagatctcagataggagagacagtctgtaaatataacgaatgtggaagaaccttcattgaaagtttaaagctgaatatatctcaaagacctcatttggaaatggagccgtatggatgcagtatttgcgggaagtccttctgcatgaatttaaggtttggacatcagagagctcttacaaaggacaatccttatgaatataatgaatatggggaaatcttctgtgacaattcagctttcattatccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagcaagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgtgtgaagtcaaacctcactgaacatcagagaacacacacaggggagaagccctatgaatgtaatgcatgtgggaaatccttctgccacagatcagccctcactgtgcatcagagaacacacacaggggagaaaccgtttatatgtaatgaatgtggaaaatccttctgtgtgaagtcaaacctcattgtacatcaaagaactcacactggggagaaaccatataagtgtaatgaatgtgggaaaaccttctgtgaaaaatcagctctcactaaacatcagaggactcacacaggggagaagccgtatgagtgtaatgcatgtgggaagacctttagtcagaggtcagtgctcaccaaacatcagagaattcacacaagggtgaaagctctttcaacatcctgaatgttagaagccttcatacacttgtgaaattggttatacagtttcaaaaaaggagatcagagaaagccaaagaatgtcagaaatttgtagaaaatgacttcttgtttgaatatgtaaaagctttcaagaaaaattaaaacttttcattagaaaatttgtactgaggggaattctattcatctaagtaatatggtgaaaatatttatctggaatttatgttgtttagtgttatattccagacgtgataccaaaattttgttgcaaatataatggacaatatttatttatacccatattcacagtggaatctgaagcttataaaagttgaatgacagcagcattaaacatatatgtgaagagtccccgatgtttgtagaccttatgtgagtatgcaaatatataaatttgagtatgcttgatttgtatattggaactcaacatgatcataaggagaagatacgtacccttaattgagtaactactatggtatttgttaatattttctacactaaataccattggtgtctttataggttgacataattatatatgtgtatgtacatatgtttgtgtgtatatgtaaatatatttctacacacatacttaaatatagtgatgtgctagtataacctcatactgacttaaaagttctgattgttaaattttaaggaattttgtgagccagttattaaaagcagtcattatttaaaatatgtaaacttacagttaaaaacaaaggtaataaatactcagcactcatcacttcctaattattttgctacatttcactattacctttgctgttttacttatttaatctgtatgatgaaaatactgtataatagtgtgcactgcacatctgtctcttcccagctccacattcagtgctgtcttggtagcttggacttagtgggagtgtttacaccatggaaattgacaaactataaatcagggttttaattttctcagagaacctgctgtcaaatatttacagcacatcactgtgtatatatgaaaacgtatttggcaatacaaaccacataccccttctatttcctgacataaataaatggctatggccatttacagctgaaccacgtcttcaagaaagaagccaaaaatatttccgtgaggtttttaactacctctgaatctgtcctactctaaatactaccggagtctctttgtaggttggccagtatatgtttttagtgaaatattatttcacaaagaactatatcacgtacctttcctctgactgtttcctggcatatatgcatgaatatggccattattgaactatcacttcagtaaagaagttaaacagtacttttctgaggtttttcagctacctctgggtcattctgtaatgtaaatgttgttaataagaatggtttttacataaattatgcaaaggttaacaagcagtaacactgcactcctcaaaaagtggcggtatgtaatgaaaggcccttttgatatccttgatttttcattgtgtatctgtttgggcacggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaaattttatatttttgtgcatccttctcccagatgacttaggtggtaagtccagattagtcaaagctaatcatggaagttccattttaatgattctgttggggtgaacttgggagcaatgagatgtttgggaagtattgtgtagtacttctgggaaagatctccttgatacaacattgtcatgacatgagaagagactctgctgggctttttcatgtctgtaacatggtattggcttatcgtttttatctctgaagggcagtagcctgaagataacagtgcacaaggtgggaaaagccagctcagaggtgacgttgccgagctactctgctctctatacctgttctctactgggactttttataaccctcaataactgttttttatttggtcttagggctgtctgatacttagagctgaaggcattccagctgacacagaggaatatttttctaagtgttaatgttctatatggtaattagggggaagaattatttcttttcacaagttaatatagggatggctgtttgtatcagccatggttctttctggtggaaaacagaattctccaactaaaaatattttaatggcagactgattacagtggtgtgggccagaaacaagggacagtgaaacacccagagacttgtatcagcaggaagccattgccattctgagccttgaagggcaaggagggaaacagtgttaccagagcccagtaagaactgctgtcatgaaggaggggccaccttgtaagagacatcattactaccagaactgtggtgccaaattgctggtgtctctctttggagaaaccaaccagatacatctgctggagagcccaggtgggcacagagaagggtggagagagaatctgggaagagaaatggagaataagcagcacagtgttattcatttctgtaaattcctatgtagaaggctcagtgttagaaataaagttattctactagttgcaagttaagtgtttctgtttgttctgctttcctgttagcataagtaaactccctttggaactacacaggtatgtctctccttcaacatgtgtgaagcagacattatattaaattacattattcatacctccctgtggtgtttcttattgtatgtggtgtaaggtaagcagctctgtattcttccaaataaatagccagttgtccctg

SEQ ID NO: 201884 - DNA, 698 bp, Homo sapiens
  Payload ID: 19827
  Gene Name: zinc finger protein 248
  ENST ID: ENST00000395873
  CDS Start-End: 399-698
tccctcgcctccggaggcggcgaggagcggcgggtgagccccggagcactgggcgagggccagggggtccccgcgctgccctgaaggcgggcgggcggcggctagacctcggcggtggggagggacccctggcgcctgcggcgacggtgggacgagggcgtctctgtcagaaggggatgaggtctggcgtgggaacgcgagttccggggctcccgggggtccgtatgcgtccagtccctgcgcctggcgctcagcgaagtcctgtagcacgggaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttt

SEQ ID NO: 201885 - DNA, 436 bp, Homo sapiens
  Payload ID: 19827
  Gene Name: zinc finger protein 248
  ENST ID: ENST00000395874
  CDS Start-End: 228-436
cgcatgtgcatccccgcctcccgctccaggcgagtccttccctggactccagtcccttgtgggaaacaatccctcgcctccggaggcggcgaggagcggcggaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattaga

SEQ ID NO: 201886 - DNA, 1705 bp, Homo sapiens
  Payload ID: 19827
  Gene Name: zinc finger protein 248
  ENST ID: ENST00000485560
  CDS Start-End: 395-730
ccacgggagactcggttttcctctctgtaaattacggatattaggaatacttgccgcctggggttgttttgagcactttcattgtttaggtgctgtatttattgggtgtgcgttccctgggagagcccgagggagacggctcctgcaccggccccaagggcctctctgcccgtggagtgcaggagcgaaggggctggcctagctgaccaccagggcccctgctggctctgaccgccctcctatcccaagtaattatttacacgtttcgcgttcgcttatgtattatgtgtaatcatggcacagtatcctgaagccgtcggagtctgtgtgctggtgcaaggtctgggacaaatttaagaagagagagctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacacattgagaactgatgtgccttcacaggaaacttggcccgtgtgtttccaggattcttgatgtttcttctgagctccagggtcaggcagtatgattgaagtttctaagccagcatccttggaataaagtagcttttgaggtaataaggagtagtccctaagaacccacgtggaaggtcacacttctgatctgagacctttcagcagagcctcagagcagagtggaaaaggccaggaaagagcatgtctggaactgcctgttcactgaagacattcttggcactcctgtacagttaaataacacttggtgatgtcagcacatgcagaaaccatggcagactgtccagtggatgggctttcaggaagaattaggctgccagcatgagcaaggggcaggcagcacaggagaggacacgtcactgcccactgtgaggactgtgaggacacagtctggggaaggcatcgcctagatggggaacttgtccctgtgctcctccataagcctgctcccttcctgtctactcactgtctttgcagcctgtggagatgcatcattgttcctattctgatgttacaaaaatcaagtgacagtgttgtataaaggtcaaaaaatgggcctagaaaatgtgacttatttaatcatttcatttgttagtggcatactcagaaaataactaattagggctgagctcggtggctcatgcctgtaatcccagcactctgggaggccgacatgggaggactgcttgaatccaggaattcaagaccagcttgggcaacatagtgagacccggtctctacaaaaaaaaagtatctggctgtggtggtgcgcacttgtagttctcctacttaagaggccgagactggaggattacttgagcttcagcccaggagttcaaggctgcagtgagctgtgaatcataccactgtggtacagcccaggcaacagagccagaccctgtctcaaaacaaaaaacaaaaaa

SEQ ID NO: 201887 - DNA, 957 bp, Homo sapiens
  Payload ID: 19827
  Gene Name: zinc finger protein 248
  ENST ID: ENST00000615949
  CDS Start-End: 578-946
gtgccctgagcccgcggggaggaggcggggctgcgggggagagcgactgcgccaggtccgcgacaaatgaattagacacaattatccacgggagactcggttttcctctctgtaaattacggatattaggaatacttgccgcctggggttgttttgagcactttcattgtttaggtgctgtatttattgggtgtgcgttccctgggagagcccgagggagacggctcctgcaccggccccaagggcctctctgcccgtggagtgcaggagcgaaggggctggcctagctgaccaccagggcccctgctggctctgaccgccctcctatcccaagtaattatttacacgtttcgcgttcgcttatgtattatgtgtaatcatggcacagtatcctgaagccgtcggagtctgtgtgctggtgcaaggtctgggacaaatttaagaagagagagaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacactcaggtttcagctcctcggaagaaagcagttcttgtgaagtaagaagaa

SEQ ID NO: 201888 - DNA, 4204 bp, Homo sapiens
  Payload ID: 19827
  Gene Name: zinc finger protein 248
  Uniprot ID: Q8NDW4
  ENST ID: ENST00000611278
  CDS Start-End: 1327-1686
gtgccctgagcccgcggggaggaggcggggctgcgggggagagcgactgcgccaggtccgcgacaaatgaattagacacaattatccacgggagactcggttttcctctctgtaaattacggatattaggaatacttgccgcctggggttgttttgagcactttcattgtttaggtgctgtatttattgggtgtgcgttccctgggagagcccgagggagacggctcctgcaccggccccaagggcctctctgcccgtggagtgcaggagcgaaggggctggcctagctgaccaccagggcccctgctggctctgaccgccctcctatcccaagtaattatttacacgtttcgcgttcgcttatgtattatgtgtaatcatggcacagtatcctgaagccgtcggagtctgtgtgctggtgcaaggtctgggacaaatttaagaagagagaggtgagctggagctgaggggtgggcgcgcaggctaacaggaacgtcacctctggagagtctgagggcagggacgggtgaaaggctcacggccacagcgaaagaaatgctgttatcacccctccgcgaacaccgggcacatccagatgagctgctgagcttcctcctctcttggcctgatatccccgccggatggtagtgcagtcaggtcatacttgggttatctgttttgaccttatttgaaagatggaaaaacaaaattgagtttgaggaggtgagtagttcagatcttgtcattccttagaggcagaactgagattagaagtcaagtctgcagtttcccgagccactgctgcccattttgttactctatatcacagtttctcattaaaagatccttttgaggaattgttagcaagttagaacaaacatttttaaacttgcatttaacatcctatccctttttttagaggtcttttgcattatctaacctcagggcattaatggtgttaacaggtaaacagataaacaatatggcctcagtttttttttttccctacaaggaattttgacaaacccatagtgttttttccttcagattactgttaacttgttaaactcatcttttcatgtttttaatttttctgtgtcacagaacctaaattggtaataaatcaataagaaatatttacattcactcagtgaaaagtgtcatgtctgagctcagcatatatcggagccacacatggacacgtaagtatcttgtgtgtggacctgtataggcaggtgaatctccgaactgcaaggccggcgaaggctctcctgacattcttcctttctaatccttcagctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacatggaatctgaagcttataaaagttgaatgacagcagcattaaacatatatgtgaagagtccccgatgtttgtagaccttatgtgagtatgcaaatatataaatttgagtatgcttgatttgtatattggaactcaacatgatcataaggagaagatacgtacccttaattgagtaactactatggtatttgttaatattttctacactaaataccattggtgtctttataggttgacataattatatatgtgtatgtacatatgtttgtgtgtatatgtaaatatatttctacacacatacttaaatatagtgatgtgctagtataacctcatactgacttaaaagttctgattgttaaattttaaggaattttgtgagccagttattaaaagcagtcattatttaaaatatgtaaacttacagttaaaaacaaaggtaataaatactcagcactcatcacttcctaattattttgctacatttcactattacctttgctgttttacttatttaatctgtatgatgaaaatactgtataatagtgtgcactgcacatctgtctcttcccagctccacattcagtgctgtcttggtagcttggacttagtgggagtgtttacaccatggaaattgacaaactataaatcagggttttaattttctcagagaacctgctgtcaaatatttacagcacatcactgtgtatatatgaaaacgtatttggcaatacaaaccacataccccttctatttcctgacataaataaatggctatggccatttacagctgaaccacgtcttcaagaaagaagccaaaaatatttccgtgaggtttttaactacctctgaatctgtcctactctaaatactaccggagtctctttgtaggttggccagtatatgtttttagtgaaatattatttcacaaagaactatatcacgtacctttcctctgactgtttcctggcatatatgcatgaatatggccattattgaactatcacttcagtaaagaagttaaacagtacttttctgaggtttttcagctacctctgggtcattctgtaatgtaaatgttgttaataagaatggtttttacataaattatgcaaaggttaacaagcagtaacactgcactcctcaaaaagtggcggtatgtaatgaaaggcccttttgatatccttgatttttcattgtgtatctgtttgggcacggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaaattttatatttttgtgcatccttctcccagatgacttaggtggtaagtccagattagtcaaagctaatcatggaagttccattttaatgattctgttggggtgaacttgggagcaatgagatgtttgggaagtattgtgtagtacttctgggaaagatctccttgatacaacattgtcatgacatgagaagagactctgctgggctttttcatgtctgtaacatggtattggcttatcgtttttatctctgaagggcagtagcctgaagataacagtgcacaaggtgggaaaagccagctcagaggtgacgttgccgagctactctgctctctatacctgttctctactgggactttttataaccctcaataactgttttttatttggtcttagggctgtctgatacttagagctgaaggcattccagctgacacagaggaatatttttctaagtgttaatgttctatatggtaattagggggaagaattatttcttttcacaagttaatatagggatggctgtttgtatcagccatggttctttctggtggaaaacagaattctccaactaaaaatattttaatggcagactgattacagtggtgtgggccagaaacaagggacagtgaaacacccagagacttgtatcagcaggaagccattgccattctgagccttgaagggcaaggagggaaacagtgttaccagagcccagtaagaactgctgtcatgaaggaggggccaccttgtaagagacatcattactaccagaactgtggtgccaaattgctggtgtctctctttggagaaaccaaccagatacatctgctggagagcccaggtgggcacagagaagggtggagagagaatctgggaagagaaatggagaataagcagcacagtgttattcatttctgtaaattcctatgtagaaggctcagtgttagaaataaagttattctactagttgcaagttaagtgtttctgtttgttctgctttcctgttagcataagtaaactccctttggaactacacaggtatgtctctccttcaacatgtgtgaagcagacattatattaaattacattattcatacctccctgtggtgtttcttattgtatgtggtgtaaggtaagcagctctgtattcttccaaataaatagccagttgtccctg

SEQ ID NO: 201889 - DNA, 4139 bp, Homo sapiens
  Payload ID: 19828
  Gene Name: zinc finger protein 25
  Uniprot ID: P17030
  ENST ID: ENST00000302609
  CDS Start-End: 214-1584
attggcgtttttttggtcttacgccctagggtggggagaggactccggtgcctccgggtctgggctgggccgcaaagggcggggcctgggcccggcgcgggccgggagcagaggccgagaccctgcaggtgattcctggggctgccagctaaggtcccttatgatttctgctctggctttgcagttttcagcctttcccaagagcagcagaaaatgaacaagttccagggacccgtgacattaaaggatgttattgtggaattcaccaaggaagaatggaagttactgacccctgctcagaggactctgtataaggatgtgatgctggaaaactatagtcaccttgtctcagtgggttaccatgtgaataagccaaatgcagtcttcaagttgaagcaaggaaaagagccatggatattagaagtagaatttccacatcggggcttccctgaagacctatggagcattcatgatctagaagcaagataccaggaaagccaagctggaaattcaaggaatggagaactcacaaaacatcagaaaactcataccacagagaaagcctgtgaatgtaaggaatgtgggaagttcttctgccagaagtctgccctcatagtacatcagcatactcactcaaagggcaaatcctatgactgtgataaatgtgggaaatctttctctaaaaatgaagacctcataagacatcagaaaattcacacgagagataaaacctatgagtgtaaagaatgtaagaaaatattttaccacctatcatctctcagtagacatctgagaacccatgcaggagagaaaccctatgaatgtaatcagtgtgaaaaatccttctaccagaaaccacatctcacagaacatcagaaaacacacacaggggagaaaccttttgaatgtactgaatgtgggaagttcttctatgtgaaggcatacctcatggtacatcagaaaacacacacaggggagaaaccctatgagtgtaaggagtgtgggaaagccttttcccagaagtcacacctcacagtacatcagagaatgcacacaggggagaaaccctataaatgtaaggaatgtgggaaattcttctctaggaattcacacctcaaaactcatcagagaagtcacacaggagagaaaccctatgaatgtaaggaatgtaggaaatgcttctaccagaagtcagccctcacagtacatcagcgaactcacacaggggagaaaccctttgaatgtaataaatgtgggaaaacattttactataaatcagacctcactaaacatcagagaaaacacacaggggagaagccctatgaatgcacagaatgtggcaaatcttttgctgtgaattcagtcctcagattacatcaaaggactcacacaggagagaagccctatgcatgcaaggaatgtgggaagtccttttctcagaagtcacattttattatacatcagagaaaacacacaggggagaagccctatgagtgtcaggagtgtggggaaacctttatccagaagtcacaactcactgcacatcagaagacacacacaaagaagaggaatgctgagaagtaagatgagttgggaaattctcttgactgaattaatccttcaaaacaatcagataattcacacaagaggtacaccttatgaatcgcatcaatagagggaaattttcagctacaatctttgctctctctgtgtatcagcaaatacatagagagattctgtacatttatttgggagaaaattttatcatattttaggcttttctaaatattagataatatagatggcagaagtcatgcaaattgtaaaacaggaaggaaacctttcagaagtcatacttttgttttgcaacatagaagtcacacaggagaaaaatcctgtaagtaaaacgaatgtcaagacattttctgtcagggcagccagctgtagacatccaaaagctcacaaatgagaagctccttgagtatctagaaatctctttacacaattggagctcatgtactagagaattcaaagggataactgcaaagacactggtagatatagaagcctttattaagaattgatgtttcattcaatttcagatcactggtacttggatagatattttaaatatttggaaggtgttcaataaaaattcaaataatttgtactgagggaaacagttatactacaaatcatgttgcagatctgatgccgagattgctctattttaaaaggaaacctgcaaatgtctacatatatgaagcttttaaaaagcacaagttatcaggcaacatcattaaacatacattaaatgtctgttagcatataggattttgtgcgtatgtgagtgtgctataacatgtaacttgcggatgttcagcgtgcatgtggaatccatccataatggtacatagcgaaataatataatcttagttcagtaactattatgtgtatgaagatgttgcacattaagtctcagtagtgactctggttgttaatatttgtattgtaagtgtaatattccttttaaattataaggcatctttttatccttttttgtgtttgtaaatggatatagacagtggtaataactaatccttcaaaaataagttaaaatgtttttgtaaaattttcaaatgtcagtcaagttttgcattagggacacatttatatatagcaaaagcctgagctgtttttaaacagctaaaaacagtagtatttattacaatctccacaatgaaaacaaatagtgcaatgtaagaaatattatgtatcttactgttgatgtgtgagcagggagcagagctatctgcatttgtatttagtgtgagagtcctaaatgttcttcaccaactttttcttcctcatagaagcaacatggcatagttaagggtgtggactctgggctcctgctgcctgggccccgattccagcatggggcatgctacttaatatctctgtgcctcagttcccatcccataaaagagtagtgatagtgacaacatcttaggattgctttgaggtctaaatgagttaacattttcaaagcacttagaatagtgtctgagacacaagagctatatgttagaggttatcatcattatttgtattttgtgaattacgctgcaaaaaaaaaaaaaatgttggctacccaacattcattccccaccttcttgctgccagtgccttgatttggttgtttgttgtttgtttgttttcctacaagtgatttaggggcagatcctgactacactaagtcagggtttgacaaatgacagtccatcagacagatctggcccactacccatttttgtatcctgcaagctaagaatggttttatatttctaaatggttgaaagaatcaaagaatattgtgacacatgaaaattatatgatattcaaatttcagtgtccataaataaagttttgaaaacatgaatacaaacaaaaaacacctatttatgtttgacctgtggctgtctttgcactaccccagcagagttgagtagttgtagcagacaccacatgcccttgagcctaagatctagcactttacaaagtaagtttttctgttacttagagctgaaaataaaagcaatgtagagttacgcttttataagtatttcatgtttcagaaatgatgcatacagcaatttgtaggtgggtggttttttgcagtatatttattttgtgcattatatttatatgttaagagcctgagcttagaagtatttttttcaaagaaatgtgttttttacttgctaaattgtcataacatcaaaacaagaaatttcttgatggaatgtagcagtaaacatatgaaataaacattgtctaaattaagtcgaattgttcattgatactgccccacagtattcctttgttttctcccaaatcaatggccagttttccctgtatcattttataattttctttctatcccataagataccattggtaagtcatacttagctaacgtaacccaataacaaaaaacttacaatacccaattccatcagctacattactagtaatctataaaattattgcctgcacttcatgtaattgtcatatgctgctacaatctaaacctgccagcgtcttacttccccttcctaataaagactttcattgat

SEQ ID NO: 201890 - DNA, 6364 bp, Homo sapiens
  Payload ID: 19829
  Gene Name: zinc finger protein 250
  Uniprot ID: P15622
  ENST ID: ENST00000292579
  CDS Start-End: 118-1800
agccctttgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccagcccctgtcgttccaggccaagctgaccttcgaggatgtggctgtgctcctctcccaggatgaatgggaccgcctgtgccctgctcagaggggtctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatgggaatgtgaaaccaagggagagagtcaaaatacagacttgagtccgaagccattaatttcagagcaaacagtgattctggggaaaacacccttggggaggattgatcaagaaaataatgaaacaaagcaaagcttctgtctgagtccaaactctgttgaccaccgtgaagttcaggtcttaagccaaagcatgccactcactccgcaccaggcagtgcctagtggagagaggccctacatgtgtgttgagtgtgggaagtgctttggccggagttcccacctccttcagcatcagcgtatccacactggagagaagccctatgtgtgcagtgtatgtgggaaggccttcagccagagctcagtccttagtaaacacaggagaattcacacaggtgagaagccctatgagtgtaatgagtgtggaaaagcctttagagtgagctcagatcttgctcagcatcacaagatacatacaggagagaagcctcacgaatgtcttgagtgtcggaaagccttcactcaactctcacatctcattcagcaccagcggatccacacgggagaaaggccatatgtgtgtccgttgtgtgggaaagccttcaaccatagcactgttctgcggagccaccagagggtacacactggggagaagcctcacaggtgcaatgagtgtgggaaaaccttcagtgtgaagaggacactgctgcagcaccagaggatccacaccggggagaagccctacacgtgcagcgagtgtgggaaggccttcagcgaccgctcagtcctcattcagcaccacaacgtgcacaccggggagaagccctatgagtgcagtgagtgtgggaagaccttcagccaccgctccacactgatgaatcacgagcggatccacaccgaggaaaagccctatgcatgctacgaatgtgggaaggccttcgttcagcactcacacctgatccagcaccagagagtccacactggggagaagccctatgtgtgtggtgaatgtgggcacgccttcagtgcacgccggtctctgatccagcatgagagaatccacacaggtgaaaagcccttccagtgcacagaatgtggcaaagccttcagcctgaaagcaactctgattgtgcacctgaggacccacacgggcgagaagccatatgagtgcaatagctgcgggaaggccttcagccagtactcagtgctcatccagcaccagcggatccacacaggcgagaagccctatgagtgcggggagtgtgggcgtgccttcaaccagcatggccacctaatccagcaccagaaagtgcacagaaagttgtgacccatggctgacacaagaatccattctcacagaaactgcatgtggaaccacaagcagccttcagcccaagagaagtctctgttaactctataggaagcttttctttggcgattcagtgtcacaaaataactccagaaagaagcacttagcgtgctgttcctgtggaaaaacttcagagactacctgttttattttcctcaacatcttgaagttatgttggagagtaatcatacaattgtagagaattttggtaaaaaacagccataattctttaacattagtttatttgaactaagggaatttaaggcataagaaccattatcccaataaaatcttacattccaaataaagttctttttctaagaacattacatgcccttcctaaatatcaattaaccatactaattattgcacttaaaatttgaaagtcggactattttcagtattctcttaaaagactaaagtattgtatggataaagtgatataaaaagatattttcatcaagcatcatgtaaaatggttggaaatcctaagtgtgtggatttccatcctaagtgtgtggagtcctgttttgtatgaaacaaggaaaaagcttatatattagtgagaaattacataaatttaaaaaactttttgtatgtgtgtgtggagatagtcttgctctgttgcccaagctgcagtgcagtggcatgatcttggctcactgcagtctccgcccccaccccaggttcaagcttttcttgtgcctcagtctcccaagtaactaggattatagatatgcgccaccacacctggctaatttttgtatttttagtagagacggagtttcaccgtgttggccaggctggtctcgaactcctggcctcaagtgatcctcccacctttgcttccgaaagtgttgggattacaggcgtgaggcaccatgcctggcctagaaaaccctttatctggagcttttaactttattcaagatcagaaaggttatgctaactttttagtaaaaattcaactcaaaaatgggtattttcctcaaaacttgcccttatgacctgcagatcctgtgccccagaaaccgtgagatgtctcaattcccatgcaggcaaaggaggggagcttcacactcagcagacctcatagctgttacaccaagtgggtacctctttacatcttatggtatttcccccaaaacaatgctgaaaatactgttctttggtagatatatttaaaacatacatttctcaaattcagatagctcttttttactatctctagtatttctattcctatatttgaaggggttttttttttcatttttttactcctggttcaagagtccagtatccattgccatattactatgatgaagatgaatctagtttattcataattaaaaatttgtattcagaattatttgttctgttttaagcatacttttttttttttttttgagacaaagtcttgctcttgttccccaggctgaagtgcaatggcacaatctcagctcactgcaatctccacctcccaggttcaagcaattctcctgcctctgcctcccaagtagctggaattacaggcacctgctaccacgcccgactaattttcgtatttttagtagagatgaggtttcaccatgttggccaggctggtctcaaactcctgacctcaggtgatccgcccgcctcggcctcccaaagtgctgggattacaggcgtgtgccaccgcacccggccaaggatacagttcttgaaaccgaatcagaaccatttctagtagcagccagctgcaaacgaaacaaatgtatgaggttcaagccacttgaaattctcaacatgttaagtgcctgagatagagaagggctgtcttcaccccaggcccccgcccccaacatctgtcagtttggtggggaggaaatagtcaccaggatattgatcctttttgtttgttttaaagacggtcttgctctgtcaccaggttggagtgcagtggtgccatcatggctcaccgctgcctcaaactcctgggctgaagcagtcctcccacctcaccttcccaaaaggttaggattacaggcatgagctgctgtgcccatccaggcattgatccttaagtccacagcaaaacaccacgatgtagacaaaagcttgttcccccttctatgtacagacactgacaacagtgaattattaactccagagaggaactggtaactgattggttaacttgagaaaggagctgacatcactggtgttttacttcagagcaactgaaaccactgaagtgaaattccagaggaactaatattactgaggtgttacttcagagggactgagatcactgaagtgaaacctcagatagctcagataaccaaggtgttaaccttagaggtgttgccattctgtgaggtgttgtttcagatagataaaataactaaggtgttagttcagagaagacaagagcttaactgtttctttggagaagagctgagatcactgaggcgtcacttcagaaagaaagtgagacaatttttgttacttcagaggatctgagtacactgaggtgtttcatcagagaggaggtgagatcactgggtgttacttctgaaaggaattgacatcactagtgggtactgcagagtagctctgaccactgaggtttacttcagaggagctgaaataacggaaatgggatcactaaggtattactttagagattagatcattgaggtaattcttcagagaagctgagatcacagaggtgtttcttcagagaagttgaaatcactaatgtgaaactctagaagaatggaggtcactgagtgctatttcataaaggaagtgaaatcactatattgtaccatcggaaagatgagaatgctgagatgttacttaggagctgagatcactgaggttctgcttcagagaaaagctgataccaatgagatgttacttaagggaggagctgaggttactgaggtattattcaggaccaagatggtgtccctcaggtgttagaagctgagatcacagagatgttacttaagagaggctgagactgctgatgtgattcttcagaaaggaaatgagatcactaagctgttaactttagaaaggagatgaaataactgagttgttcactggagttgagatcacacaggtgttaacttcagaggtggctgaaatcactaaggtgattcttcagagaaaggttgagatcactaggggtgatgctttagaaagaggttactttagggaaaagctatgatcactgagaagttacttcagaatggagctgagatcactgaggtaacagtccaaagaggaactgagattactgaggtgttacttcagagccaagagatcacccaggtacctagatgagatcactgagatgaaagtccagaaacctgaggtcacctcaatattaattgagagaaaatgagaacactgtggtgctatcttaaatcttctatgaaaggaagctgccaacctgtgttagctgagtccacagctggcatgtgactcagtggcagctgctcagtgcccactactattcaggccccaatttctaatcattaaagacaaagtcatattccaattaagatgagaataattaaattcaatatacaggaacatttgtttagaaagactgtgtatcacaggacaacgtaagttacacagtacaagttattctggattccaataacctagggttttcagggaaatccttccaaaaagtatagtttttttcctgcattcttaaaatgagcttaatatcattctgcctgttcttgctatgtcaggctgccattgatccactggtgagaatgcaggctcaggtgtccacggagccaggaagtgggcttcaatgcccttctttctgaggaggattcccaggctacattttcttgccactcacctcctcctctccaaggagaaagaggtggcacatgacctactggaacatgtgggctatctacctttttgggatataacatcaaaggccagggccctgaattttcatgctgataacagtcttctcaaccattatcttctgcctgatttgtcagcagcattccacctttattttggatttgttttattcagaagtctgtatattttaggtatttaaatacttctctttggctgggtgcaatggctcacacctgtaatcccagcactttgggaggctgaagtgggtggatcgcttgagcccaggactttgagaccagcatggcgaaaacccgtctctacaaaaaaaaaattagctgggtgttgtggcttgcgcctgtagtcccagatacgtgggaggctaaggtgggaggattgattgggagttcaagactagtgtgctgtgatcatactatctagcctggacaacagagagagaccttgtcacaaaaaatacgtatatatttcttttaaaattgtttcttctaacagctattaagaatttgaaacttggttctcttcaaattttctattattttggaaaacattttagtctgcctggaatttctgtgtataatctgacgctttccaataaaaaagtaatgactggaacaag

SEQ ID NO: 201891 - DNA, 2131 bp, Homo sapiens
  Payload ID: 19829
  Gene Name: zinc finger protein 250
  Uniprot ID: P15622
  ENST ID: ENST00000417550
  CDS Start-End: 88-1755
cgttccttcgcgcgtgaggctgcggctctgacgccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggtctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatgggaatgtgaaaccaagggagagagtcaaaatacagacttgagtccgaagccattaatttcagagcaaacagtgattctggggaaaacacccttggggaggattgatcaagaaaataatgaaacaaagcaaagcttctgtctgagtccaaactctgttgaccaccgtgaagttcaggtcttaagccaaagcatgccactcactccgcaccaggcagtgcctagtggagagaggccctacatgtgtgttgagtgtgggaagtgctttggccggagttcccacctccttcagcatcagcgtatccacactggagagaagccctatgtgtgcagtgtatgtgggaaggccttcagccagagctcagtccttagtaaacacaggagaattcacacaggtgagaagccctatgagtgtaatgagtgtggaaaagcctttagagtgagctcagatcttgctcagcatcacaagatacatacaggagagaagcctcacgaatgtcttgagtgtcggaaagccttcactcaactctcacatctcattcagcaccagcggatccacacgggagaaaggccatatgtgtgtccgttgtgtgggaaagccttcaaccatagcactgttctgcggagccaccagagggtacacactggggagaagcctcacaggtgcaatgagtgtgggaaaaccttcagtgtgaagaggacactgctgcagcaccagaggatccacaccggggagaagccctacacgtgcagcgagtgtgggaaggccttcagcgaccgctcagtcctcattcagcaccacaacgtgcacaccggggagaagccctatgagtgcagtgagtgtgggaagaccttcagccaccgctccacactgatgaatcacgagcggatccacaccgaggaaaagccctatgcatgctacgaatgtgggaaggccttcgttcagcactcacacctgatccagcaccagagagtccacactggggagaagccctatgtgtgtggtgaatgtgggcacgccttcagtgcacgccggtctctgatccagcatgagagaatccacacaggtgaaaagcccttccagtgcacagaatgtggcaaagccttcagcctgaaagcaactctgattgtgcacctgaggacccacacgggcgagaagccatatgagtgcaatagctgcgggaaggccttcagccagtactcagtgctcatccagcaccagcggatccacacaggcgagaagccctatgagtgcggggagtgtgggcgtgccttcaaccagcatggccacctaatccagcaccagaaagtgcacagaaagttgtgacccatggctgacacaagaatccattctcacagaaactgcatgtggaaccacaagcagccttcagcccaagagaagtctctgttaactctataggaagcttttctttggcgattcagtgtcacaaaataactccagaaagaagcacttagcgtgctgttcctgtggaaaaacttcagagactacctgttttattttcctcaacatcttgaagttatgttggagagtaatcatacaattgtagagaattttggtaaaaaacagccataattctttaacattagtttatttgaactaagggaatttaaggcataagaaccattatcccaataaaatcttacattccaaataaagttctttttctaagaacattacatgc

SEQ ID NO: 201892 - DNA, 677 bp, Homo sapiens
  Payload ID: 19829
  Gene Name: zinc finger protein 250
  ENST ID: ENST00000528258
  CDS Start-End: 136-441
gcgcagacggggcggggcagccctttgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggtctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagatcctgtgccccagaaaccgtgagatgtctcaattcccatgcaggcaaaggaggggagcttcacactcagcagacctcatagctgttacaccaatggcttctgctgtggctatcccatgtccggtgtgaggagacagtggtatgactcatccctttgtgtccggaattggtgggttcttggtctcactgacgtcaagaatgaagctgcggaccctcgtggtgagtgttacagttcttaaaggcagtgtgtctggagttt

SEQ ID NO: 201893 - DNA, 592 bp, Homo sapiens
  Payload ID: 19829
  Gene Name: zinc finger protein 250
  ENST ID: ENST00000525694
  CDS Start-End: 170-592
cgcgcgtgaggctgcggctctgacggtgtgtaacttgtatgtggaaggaccaacgtagcatttgcctcagcaacatccttgaatctgcaccctcacccacatccattcttatcagccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggtctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatgggaatgtgaaaccaagggagagagtcaaaatacagacttgagtccgaagccattaatttcagagcaaacagtgattctg

SEQ ID NO: 201894 - DNA, 687 bp, Homo sapiens
  Payload ID: 19829
  Gene Name: zinc finger protein 250
  ENST ID: ENST00000529780
  CDS Start-End: 122-490
gggcagccctttgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggtctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatgggatcctgtgccccagaaaccgtgagatgtctcaattcccatgcaggcaaaggaggggagcttcacactcagcagacctcatagctgttacaccaatggcttctgctgtggctatcccatgtccggtgtgaggagacagtggtatgactcatccctttgtgtccggaattggtgggttcttggtctcactgacgtcaagaatgaagctgcggaccctcgtgg

SEQ ID NO: 201895 - DNA, 593 bp, Homo sapiens
  Payload ID: 19829
  Gene Name: zinc finger protein 250
  ENST ID: ENST00000533221
  CDS Start-End: 80-593
cgcgcgtgaggctgcggctctgacgccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggtctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagaatgtgaaaccaagggagagagtcaaaatacagacttgagtccgaagccattaatttcagagcaaacagtgattctggggaaaacacccttggggaggattgatcaagaaaataatgaaacaaagcaaagcttctgtctgagtccaaactctgttgaccaccgtgaagttcaggtcttaagccaaagcatgccactcactccgcaccaggcagtgcctagtggagagaggc

SEQ ID NO: 201896 - DNA, 672 bp, Homo sapiens
  Payload ID: 19829
  Gene Name: zinc finger protein 250
  ENST ID: ENST00000533622
  CDS Start-End: 145-672
cttcgcgcgtgaggctgcggctctgacggtgagtggggggcgcgtgtcgtcgccggccaggaccctctcccatcacggacaccggagccgccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggtctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatgggaatgtgaaaccaagggagagagtcaaaatacagacttgagtccgaagccattaatttcagagcaaacagtgattctggggaaaacacccttggggaggattgatcaagaaaataatgaaacaaagcaaagcttctgtctgagtccaaactctgttgaccaccgtgaagttcaggtcttaagc

SEQ ID NO: 201897 - DNA, 610 bp, Homo sapiens
  Payload ID: 19829
  Gene Name: zinc finger protein 250
  ENST ID: ENST00000527049
  CDS Start-End: 475-610
ggccgagtgggcgacggagacggtcgctgttcagtgacgccccctgtcgggagcacgccgggccggacacagcgaagagcggctgcgcctcggacctcgcagcactcagcctcctaagtgggaggaataacctcacgcaagtcatcaaacaagaggacttcagtgttgcaacgaaggaagagaaagggcccctgagaaggcgacattcgcactgcagcggcgcagggaccagccaggcggctgagggcaaggtcgttcccagcagcgggaaccgcaagggcaaaaggctcggaggggggaacgagctcgagttccaggacggccgaagccagcgcaagtcgaggagggactgcggggccggcaggggtgtcctccacagggcgacggcggcaggagctcgggaaccgggactgcgagcggccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggtctctacagaaatgtga

SEQ ID NO: 201898 - DNA, 702 bp, Homo sapiens
  Payload ID: 19829
  Gene Name: zinc finger protein 250
  ENST ID: ENST00000533543
  CDS Start-End: 122-505
gggcagccctttgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccagcccctgtcgttccaggccaagctgaccttcgaggatgtggctgtgctcctctcccaggatgaatgggaccgcctgtgccctgctcagaggggtctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatgggatcctgtgccccagaaaccgtgagatgtctcaattcccatgcaggcaaaggaggggagcttcacactcagcagacctcatagctgttacaccaatggcttctgctgtggctatcccatgtccggtgtgaggagacagtggtatgactcatccctttgtgtccggaattggtgggttcttggtctcactgacgtcaagaatgaagctgcggaccctcgtgg

SEQ ID NO: 201899 - DNA, 2807 bp, Homo sapiens
  Payload ID: 19830
  Gene Name: zinc finger protein 251
  Uniprot ID: Q9BRH9
  ENST ID: ENST00000292562
  CDS Start-End: 277-2292
gcgttctcggaggcgtactgaggccccgcagggggcggggaagcctgcgtgtgcgcagctcggcccggcccgccctcttcatcctagcccgccccctccccggctctggacccggttctgtgggagggtccgttccgggctcggtgcgactgcgcagctcctcggcgcttcctcggtggcttccccgggtcgagcaaacaggtaagttcggggagacttcaggccagggcagtctcctgtcttctcttggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaagattctgaggttgggaccaagaaggaactatctattttaaaccaaaaattttccgaagaagtaaaaaccccagaatttgtatcaagaagactcttaagggataatgcacaggccgctgagtttcgggaagcatggggccgtgagggcaaactcaaagagcgcgtgggaaattctgccgggcagagtttgaacaaacccaatattcacaagagagttttaacagaagctaccgtgggcagggaaagatctttgggagaaagaacccaagagtgtagtgcatttgatagaaacttgaatctggaccaaaatgttgttagacttcaaagaaataaaacaggagagagggtctttaaatgtgatatatgcagcaaaaccttcaaatataattcagacctaagtagacaccagagaagtcacactggggagaagccgtacgaatgtggccggtgtgggcgagcctttactcacagctcaaatcttgttctgcaccatcacattcacactggaaataaaccatttaaatgtgatgaatgtgggaaaacttttggactcaattctcacctccgtcttcatcggagaattcacactggagaaaaaccctttggctgtggtgagtgtgggaaggctttcagtcgaagctcaactcttattcaacatcggatcattcacacaggagagaaaccctacaagtgtaatgaatgtggaagaggctttagccagagcccccagttaactcagcatcagagaattcacactggagagaagccgcatgaatgcagtcactgtgggaaggccttcagtcgaagctccagccttattcagcatgagagaattcacactggagagaagccccataaatgcaatcagtgtgggaaggccttcagtcagagctcaagccttttcctccatcatcgggttcatactggagagaaaccctatgtatgtaatgaatgcggcagagcctttggttttaactctcatcttactgaacacgtaaggattcacacaggagaaaaaccctatgtttgtaatgagtgcggcaaagcctttcgtcggagttccactcttgttcagcatcgaagagttcacactggggagaagccctaccagtgcgttgaatgtgggaaagctttcagccagagctcccagctcaccctacatcagcgagttcacactggagagaagccctatgactgtggtgactgtgggaaggccttcagccggaggtcaaccctcattcagcatcagaaagttcacagcggagagactcgtaagtgcagaaaacatggtccagcctttgttcatggctccagcctcacagcagatggacagattcccactggagagaagcacggcagagcctttaaccatggtgcaaatctcattctgcgctggacagttcacactggtgagaaatcctttggatgtaatgaatatggaaaagctttcagtcccacctcacgacccactgaagatcagataatgcatgctggggaaaagccctataaatgtcaagaatgtggaaacgccttcagtggaaagtcaacccttattcaacatcaggtaactcacactggtcagaaaccatgtcattgcagtgtgtatgggaaagccttcagccagagttcacagctcacaccacctcagcagactcgtgttggagagaaacctgctttaaatgatggctctaaaagatactttattcatatcaagaagattttccaagaaagacatttttaatgtgataaatgcagaagacagtttagcaactgttcacttgacattagaagataagatggcataatgaaagatatataaggtctaaatattactggcaaagtaaaataaatagttcagatgactactaaagtcaaagtcattaaatctggaagtaaacacgagaattcattctgggaaatcaggctgtctgtgtaaaggttactgctgtgctcaggagttgaaccgtgtggtgctgtatccggatactcatgacgaatggatggagggcgtgaaaagtgagcccagctggtgctctgggtctaccctacctgacatccttccagtcttatcctttgtttcctatccaggcccaggcttgtggctgagaacatccactttcagtcccatatacctgcctccaagtgtggtacagagaacttgggcctgctgggggcgcttagccttactctctccaccacctctcccaccaacccccagatgaactgcaggtagacgtttcttccttgcttggagcc

SEQ ID NO: 201900 - DNA, 618 bp, Homo sapiens
  Payload ID: 19830
  Gene Name: zinc finger protein 251
  ENST ID: ENST00000525191
  CDS Start-End: 1-442
gcgcttcctcggtggcttccccgggtcgagcaaacaggtaagttcggggagacttcaggccagggcagtctcctgtcttctcttggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaaggtgagaatggatgggatgctaatcctgggagcagcctcccaatcctgccttaagaggctccaagcgagggacagctggggcatggcgttcatattaatggcctcccccaggggcagtctcacagatacagcccctctacaaatgtgagcatgtgcacatgctttagaagttttatcttgctggtctgtttctttgctttaaaaatatatatatactacttctgatcata

SEQ ID NO: 201901 - DNA, 3027 bp, Homo sapiens
  Payload ID: 19830
  Gene Name: zinc finger protein 251
  Uniprot ID: Q9BRH9
  ENST ID: ENST00000612318
  CDS Start-End: 277-2292
gcgttctcggaggcgtactgaggccccgcagggggcggggaagcctgcgtgtgcgcagctcggcccggcccgccctcttcatcctagcccgccccctccccggctctggacccggttctgtgggagggtccgttccgggctcggtgcgactgcgcagctcctcggcgcttcctcggtggcttccccgggtcgagcaaacaggtaagttcggggagacttcaggccagggcagtctcctgtcttctcttggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaagattctgaggttgggaccaagaaggaactatctattttaaaccaaaaattttccgaagaagtaaaaaccccagaatttgtatcaagaagactcttaagggataatgcacaggccgctgagtttcgggaagcatggggccgtgagggcaaactcaaagagcgcgtgggaaattctgccgggcagagtttgaacaaacccaatattcacaagagagttttaacagaagctaccgtgggcagggaaagatctttgggagaaagaacccaagagtgtagtgcatttgatagaaacttgaatctggaccaaaatgttgttagacttcaaagaaataaaacaggagagagggtctttaaatgtgatatatgcagcaaaaccttcaaatataattcagacctaagtagacaccagagaagtcacactggggagaagccgtacgaatgtggccggtgtgggcgagcctttactcacagctcaaatcttgttctgcaccatcacattcacactggaaataaaccatttaaatgtgatgaatgtgggaaaacttttggactcaattctcacctccgtcttcatcggagaattcacactggagaaaaaccctttggctgtggtgagtgtgggaaggctttcagtcgaagctcaactcttattcaacatcggatcattcacacaggagagaaaccctacaagtgtaatgaatgtggaagaggctttagccagagcccccagttaactcagcatcagagaattcacactggagagaagccgcatgaatgcagtcactgtgggaaggccttcagtcgaagctccagccttattcagcatgagagaattcacactggagagaagccccataaatgcaatcagtgtgggaaggccttcagtcagagctcaagccttttcctccatcatcgggttcatactggagagaaaccctatgtatgtaatgaatgcggcagagcctttggttttaactctcatcttactgaacacgtaaggattcacacaggagaaaaaccctatgtttgtaatgagtgcggcaaagcctttcgtcggagttccactcttgttcagcatcgaagagttcacactggggagaagccctaccagtgcgttgaatgtgggaaagctttcagccagagctcccagctcaccctacatcagcgagttcacactggagagaagccctatgactgtggtgactgtgggaaggccttcagccggaggtcaaccctcattcagcatcagaaagttcacagcggagagactcgtaagtgcagaaaacatggtccagcctttgttcatggctccagcctcacagcagatggacagattcccactggagagaagcacggcagagcctttaaccatggtgcaaatctcattctgcgctggacagttcacactggtgagaaatcctttggatgtaatgaatatggaaaagctttcagtcccacctcacgacccactgaagatcagataatgcatgctggggaaaagccctataaatgtcaagaatgtggaaacgccttcagtggaaagtcaacccttattcaacatcaggtaactcacactggtcagaaaccatgtcattgcagtgtgtatgggaaagccttcagccagagttcacagctcacaccacctcagcagactcgtgttggagagaaacctgctttaaatgatggctctaaaagatactttattcatatcaagaagattttccaagaaagacatttttaatgtgataaatgcagaagacagtttagcaactgttcacttgacattagaagataagatggcataatgaaagatatataaggtctaaatattactggcaaagtaaaataaatagttcagatgactactaaagtcaaagtcattaaatctggaagtaaacacgagaattcattctgggaaatcaggctgtctgtgtaaaggttactgctgtgctcaggagttgaaccgtgtggtgctgtatccggatactcatgacgaatggatggagggcgtgaaaagtgagcccagctggtgctctgggtctaccctacctgacatccttccagtcttatcctttgtttcctatccaggcccaggcttgtggctgagaacatccactttcagtcccatatacctgcctccaagtgtggtacagagaacttgggcctgctgggggcgcttagccttactctctccaccacctctcccaccaacccccagatgaactgcaggtagacgtttcttccttgcttggagccccagtttttgcatttcattttcattaaaatgaaaggtggtttggttttggttctaaggagctctacagtttaacagagagagggaccttaggggccaagaaagcaggggcctaccaagtatctccacttttgaaaattgtaattactgataaaaaattttttaaaggcaggtttattgaagcataatttataaacaataaaatttactctttttagtgta

SEQ ID NO: 201902 - DNA, 616 bp, Homo sapiens
  Payload ID: 19830
  Gene Name: zinc finger protein 251
  ENST ID: ENST00000633636
  CDS Start-End: 1-442
gcgcttcctcggtggcttccccgggtcgagcaaacaggtaagttcggggagacttcaggccagggcagtctcctgtcttctcttggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaaggtgagaatggatgggatgctaatcctgggagcagcctcccaatcctgccttaagaggctccaagcgagggacagctggggcatggcgttcatattaatggcctcccccaggggcagtctcacagatacagcccctctacaaatgtgagcatgtgcacatgctttagaagttttatcttgctggtctgtttctttgctttaaaaatatatatatactacttctgatca

SEQ ID NO: 201903 - DNA, 2268 bp, Homo sapiens
  Payload ID: 19831
  Gene Name: zinc finger protein 253
  Uniprot ID: O75346
  ENST ID: ENST00000355650
  CDS Start-End: 96-1367
gtgcttatagaggcccgtcctctgtggccgtgtgacctgcaagtattgggagagccacagctaaaccccgggacccctggaagcctagaaatgttatgagttctcattttgcccaagacctttggccagagaacatacaaaattctttccaaatagggatgctgagaagatatgaagaatgcagacatgacaatttacagttaaaaaaaggctgtaaaagcgtgggtgagcataaggtgcacaaaggaggttataatggacttaaccaatgtttgacaactacccagaaagaaatatttcaatgtgataaatatggaaaagtctttcataagttttcaaattcaaacacatataagacaagacatactggaataaatcttttcaaatgtataatatgtggcaaagcttttaaacggtcctcaacccttactacacataagaaaattcatactggagagaaaccttacagatgtgaagaatgtggcaaagcttttaaccaatctgcaaaccttactacacataagagaattcataccggagagaaaccctacagatgtgaagaatgtggcaaagcctttaagcagtcctcaaaccttactacacataagaaaattcatactggagagaaaccctacaaatgtgaagaatgtggcaaagccttcaaccgatccacagaccttactacacataagatagttcatactggagagaaaccctacaaatgtgaagaatgtggcaaagcctttaagcacccctcacacgttaccacacataagaaaattcatactagagggaaaccctacaactgtgaagaatgtggcaaatcctttaagcactgctctaaccttactatacataagagaattcatacaggagagaaaccctacaaatgtgaagaatgtggcaaagcctttcacctatcctcacaccttactacacataagatacttcatactggagagaaaccctacagatgtagagaatgtggcaaagcttttaaccattccacaacccttttttcacatgagaaaattcatactggagagaaaccctacaaatgtgatgaatgtggcaaaacctttacctggccctcaatcctctccaaacataaaagaactcatactggagagaaaccctacaaatgtgaagaatgtggcaaatcctttactgcatcctcaactctaactacacataagagaattcatactggagagaaaccttacaaatgtgaagaatgtggcaaagcttttaactggtcctcagaccttaataaacataagaaaattcatattgaacgaaaaccctacatagtgaagaatgtgacagatcttttaaatgttcctccacttttaattagcataagataattcatactggagagaaaccctatgaatgtgatgaatgtgggaaagcctttaaccagccctcgactcttagtaaatttgagagtttatatggaacacaaaccctacaaatataaagaatgtgacaaagctttttaaggaagttctcaacccttattacacataattcataccaaacagaagccctacaagtgtgaagaatgtggcaaaacctataaacctataacaagttctcaattcctttttttttgagatggagtttcactcttgtcaccgaggctggagtgcaatgacatgatctccgttcactgcaatctctgcctcctgggtttaagccattcttctgcctcagcctcccaagtagctgggattacaggtgcccaacaccacgcctggctaatttttggatttttagtagagatggggtttcacaatgttggccaggctggtctcgaactcctgacctcaggtgatccacctgccttggccttccaaagtgctggggttacaggcgtgagccaccatgcctggctacaagttcttaattcttaagagacaccatgcctggctacaagttcttaattcttaagagacatggcgataattcatgctgaagaggaaatctggaaacctgaaagatgcgacattgcttttaccaacacctccacatttcctatacataaaaataaattatactagtgtaataccctagaaatgtataaaatgtgacaaagcctttatatgattgtcatacatgattgtaggtgatagaagtcatactgccaaaactcctgtaagtgtgaagaatgtggcaaaatattttattagtgcttataccttatttcacaggaaagctcttatccttgagaaaaattgtgcaaatacaaagaatatggaaaaacca

SEQ ID NO: 201904 - DNA, 820 bp, Homo sapiens
  Payload ID: 19831
  Gene Name: zinc finger protein 253
  ENST ID: ENST00000592725
  CDS Start-End: 177-820
atcctcagtgttctgtgtcctgtgcttatagaggcccgtcctctgtggccgtgtgacctgcaagtattgggagagccacagctaaaccccgggacccctggaagcctagaaatggtattgttgtctctaagccagacctggttacctgtctggagcaaggaaaaaaacctttaactatggaaagacatgagatgattgccaaacccccagttatgagttctcattttgcccaagacctttggccagagaacatacaaaattctttccaaatagggatgctgagaagatatgaagaatgcagacatgacaatttacagttaaaaaaaggctgtaaaagcgtgggtgagcataaggtgcacaaaggaggttataatggacttaaccaatgtttgacaactacccagaaagaaatatttcaatgtgataaatatggaaaagtctttcataagttttcaaattcaaacacatataagacaagacatactggaataaatcttttcaaatgtataatatgtggcaaagcttttaaacggtcctcaacccttactacacataagaaaattcatactggagagaaaccttacagatgtgaagaatgtggcaaagcttttaaccaatctgcaaaccttactacacataagagaattcataccggagagaaaccctacagatgtgaagaatgtggcaaagcctttaagcagtcctcaaaccttactacacataagaaaattcatactggagagaaaccctacaaatgtgaagaatgtggcaaagccttcaaccgatccacagaccttactacacataagatagttcatac

SEQ ID NO: 201905 - DNA, 3519 bp, Homo sapiens
  Payload ID: 19831
  Gene Name: zinc finger protein 253
  Uniprot ID: O75346
  ENST ID: ENST00000589717
  CDS Start-End: 93-1592
ctgtgcttatagaggcccgtcctctgtggccgtgtgacctgcaagtattgggagagccacagctaaaccccgggacccctggaagcctagaaatgggaccattgcaatttagagatgtggccatagaattctctctggaggagtggcattgcctggacactgcacagcggaatttatatagggatgtgatgttagagaactacagaaacttggtcttccttggtattgttgtctctaagccagacctggttacctgtctggagcaaggaaaaaaacctttaactatggaaagacatgagatgattgccaaacccccagttatgagttctcattttgcccaagacctttggccagagaacatacaaaattctttccaaatagggatgctgagaagatatgaagaatgcagacatgacaatttacagttaaaaaaaggctgtaaaagcgtgggtgagcataaggtgcacaaaggaggttataatggacttaaccaatgtttgacaactacccagaaagaaatatttcaatgtgataaatatggaaaagtctttcataagttttcaaattcaaacacatataagacaagacatactggaataaatcttttcaaatgtataatatgtggcaaagcttttaaacggtcctcaacccttactacacataagaaaattcatactggagagaaaccttacagatgtgaagaatgtggcaaagcttttaaccaatctgcaaaccttactacacataagagaattcataccggagagaaaccctacagatgtgaagaatgtggcaaagcctttaagcagtcctcaaaccttactacacataagaaaattcatactggagagaaaccctacaaatgtgaagaatgtggcaaagccttcaaccgatccacagaccttactacacataagatagttcatactggagagaaaccctacaaatgtgaagaatgtggcaaagcctttaagcacccctcacacgttaccacacataagaaaattcatactagagggaaaccctacaactgtgaagaatgtggcaaatcctttaagcactgctctaaccttactatacataagagaattcatacaggagagaaaccctacaaatgtgaagaatgtggcaaagcctttcacctatcctcacaccttactacacataagatacttcatactggagagaaaccctacagatgtagagaatgtggcaaagcttttaaccattccacaacccttttttcacatgagaaaattcatactggagagaaaccctacaaatgtgatgaatgtggcaaaacctttacctggccctcaatcctctccaaacataaaagaactcatactggagagaaaccctacaaatgtgaagaatgtggcaaatcctttactgcatcctcaactctaactacacataagagaattcatactggagagaaaccttacaaatgtgaagaatgtggcaaagcttttaactggtcctcagaccttaataaacataagaaaattcatattgaacgaaaaccctacatagtgaagaatgtgacagatcttttaaatgttcctccacttttaattagcataagataattcatactggagagaaaccctatgaatgtgatgaatgtgggaaagcctttaaccagccctcgactcttagtaaatttgagagtttatatggaacacaaaccctacaaatataaagaatgtgacaaagctttttaaggaagttctcaacccttattacacataattcataccaaacagaagccctacaagtgtgaagaatgtggcaaaacctataaacctataacaagttctcaattcctttttttttgagatggagtttcactcttgtcaccgaggctggagtgcaatgacatgatctccgttcactgcaatctctgcctcctgggtttaagccattcttctgcctcagcctcccaagtagctgggattacaggtgcccaacaccacgcctggctaatttttggatttttagtagagatggggtttcacaatgttggccaggctggtctcgaactcctgacctcaggtgatccacctgccttggccttccaaagtgctggggttacaggcgtgagccaccatgcctggctacaagttcttaattcttaagagacaccatgcctggctacaagttcttaattcttaagagacatggcgataattcatgctgaagaggaaatctggaaacctgaaagatgcgacattgcttttaccaacacctccacatttcctatacataaaaataaattatactagtgtaataccctagaaatgtataaaatgtgacaaagcctttatatgattgtcatacatgattgtaggtgatagaagtcatactgccaaaactcctgtaagtgtgaagaatgtggcaaaatattttattagtgcttataccttatttcacaggaaagctcttatccttgagaaaaattgtgcaaatacaaagaatatggaaaaaccattaatgcctactcacatcttactgaacagaagaaggttcatagttaataaagcattaaaagtgcaattactgtcaaaaaatctttcagaaaatagaagtctttaaagtgaagaatatttattctgaagacagccattacaaatataaagggggttgtagtgcctttacttgtgtcacagatcttagtgcacacatgtagtactagaggaaaaccctgaagcagttgctcaagctttgtttcagggaatcaagggaatttatattgagaatagtactgcaaatgtaatgaatggaaagacttttcttttccaaaaatgacagcttagaaaacaccagagggtttataccaaaatatatttttgcagatgcagtaaatatcaaaaaatatttaattcaaaattgattctatgtaaatatcagagaattttccatagaataattaaggcactgacacttcagacattacactaaatcagaatgttcagtataaaaactaatccacagctacagctgttagataaattatttctatataattttttaaaaagtggatttttgaagcactgtaattacattgaaagtatacttgttttcttgaaaaaatttttttgaaaagtgaataatgatataatacagctttcacattgctttatgctattttattcctattatattcacatgtgaaagcatgtgatcaattgttgctgcattagagatattagagattgttttttattagttgggcattatgtatgaccttttctataaaagagtaaggacattaaaatgtaagatgcatgatgaaaatataagtggagaggctctttgtagttaactgatattaagtaatgtgtaaggtgggggttcatgttctcatttctataatcctagccaatgacttaatgttgatgctttgaatgtcttttggatggtctaacctacattaacatgtatgcggaacatcttaaaactttttttcaaaaatcataatgaattattttattaataagcaaagataaaaaataa

SEQ ID NO: 201906 - DNA, 511 bp, Homo sapiens
  Payload ID: 19832
  Gene Name: zinc finger protein 254
  ENST ID: ENST00000339642
  CDS Start-End: 125-400
ggggcctttgtctctcgctgtcgccggagtcccaggtctgtcttcactgctctgtgtcctctgctcctagaggcccagcctctgtggcgctgttaccagcaggtattggagatccacagctaagatgccaggaccccctagaagcctagaaatgggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggattggatttttcattactgtgaagaaaaacactggaattttgataaggagttctttaaatctacaggtcactttggataatatggcagtttcataatacttattctttcaatagaaataaaacattttaaaat

SEQ ID NO: 201907 - DNA, 3967 bp, Homo sapiens
  Payload ID: 19832
  Gene Name: zinc finger protein 254
  Uniprot ID: O75437
  ENST ID: ENST00000357002
  CDS Start-End: 116-2095
gtctctcgctgtcgccggagtcccaggtctgtcttcactgctctgtgtcctctgctcctagaggcccagcctctgtggcgctgttaccagcaggtattggagatccacagctaagatgccaggaccccctagaagcctagaaatgggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcctaagcaactctcaacccttactacacatgaaataattcatgctggagagaaactctacaaatgtgaagaatgtggtgaagcttttaatcgatcctcaaatcttactacacataagataattcatactggagagaaaccttacaagtgtgaagaatgtggcaaagcatttatctggtcctcaacccttactgagcataagaaaattcatactagaaagaaaccctacaagtgtgaagaatgtggcaaagcatttatatggtcctcaacactaactagacataagaggatgcacactggagagaaaccctacaaatgtgaagaatgtggcaaagcttttagccagtcctcaacccttactacacataagataattcatactggagagaaacgctacaaatgcttagaatgtggcaaagcttttaagcaactctcaactcttactacacataaaataattcatgttggagagaaactctacaaatgtgaagaatgcggcaaaggttttaatcgatcttcaaatcttactacacataagataattcatactggagagaaaccttacaagtgtgaagaatgtggcaaagcatttatctggtcctcaacccttactaaacataagagaattcatactagagagaaaccctacaaatgtgaagaatgtggcaaggcatttatatggtcctcaaccctaactagacataagaggatgcacactggagagaaaccctacaaatgtgaagaatgtggcaaatcttttagccaatcctcaacccttactacacataagataattcatactggagagaaaccctacaaatgtgaagaatgtggcaaagcctttaactggtcctcaactcttactaaacataagataattcatactgaagagaaaccctacaaatgtgaaaaatgtggcaaagcctttaagcagtcttcaatccttactaaccataagagaattcatactggagagaaaccctataaatgtgaagaatgtggcaaatcttttaaccggtcttcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattctaattactctcagaagatctgtcagaaagtatgtctttaaagtatagaagagcatttattttgaaaaaaacattacacatatgaagaggattgtaatatctttacttgtaccacagatcttattgtacacattttatactagagaaaaaccctcaggcagttgttaaaattttgttgaacatcagggagtttaagaaaaccctgcaagtataatgaatttggaaaaacattttttcaaaaactacaaattataaaacaccaaagtgttcatactaaaatatatttttgcagatacattaaatatgaaagatattcaatccaaaattaagtctatgtaaatatcagggaataattcacagtagaaatatctagggcattcaagctttagacattacactaaatcagagtgctgagtatagaaaataatacaaacagatttgtctaaacatttgtatataactttaaaaatagaatattttttggagggttataattacattcaaagtacttttttttgaaaatacagattttttttaaaagtgaataatgtgttcaactcttaaattcatgctgtttcatcattgctggtgtattcatatgtgaaagcatgtgactaattgttgctgcataaaagatatgagattcttttttattaggcattatttatgaccttttctatgaaaagataaggacattaaaatgtaagatgcgtgaggaaaatttaggtagagaggctctttgtggttaacttataatattgagtgatgcatgaggtaggtgttcagaataatattcctctgcattattatgaatgaaaagcattcttaattttagttaaaattaagttagtcatatgttattttattaattgtacttctatgaaataatatgcagtctatttttaaattataaattatgtgtgaacttagcttttcaattcaacatttttaacatattaaatactattgtgaattcaatgaagtgttcttatgccactaactttaacctattcccttactcaaggatgtaggtaaaagatggtaacaatacactatttggtaagataatgtactgacatctctagcaatcttttttgccagtggctttaaattgccaataagttaaagaatattgttcctatgggttaaatttttattcttattttcacatttaaatttatttttcttaatttttgtggatacataatatgtgtatatatgtatgccatatatggtatattttgatgcaggcatactctatataataatcacattagaggaaatgagatatccattacctctagcatttattctttttattacaagcaattcaattgtacacttttagttatttttaaatttacaatgttattgattacagggtcatttttatggtcataataaaaaattttatacaaacgtgtaaaatctatacatttctgagttctgaataaatatttttaaaaattttaa

SEQ ID NO: 201908 - DNA, 4021 bp, Homo sapiens
  Payload ID: 19832
  Gene Name: zinc finger protein 254
  ENST ID: ENST00000342944
  CDS Start-End: 316-2040
aatcaagcgcgcagttgaagaggagtgcatggtttccggcatttggctgggcctttgtctctcgctcccaccagagcttggaatccgtctctgctcttctgcattctccacctcgggagcccctggggactctgtgacggcctctgttgccctgtgatctgcaggtccggagagacgcacagctaagatgtcaggacatcctggaagctgggaaagggtcttgccatctctaagctggacctggtgacctttttggagggaaagaaagagccctggactgtgaagagtgaggagaccatagctgcacagccaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcctaagcaactctcaacccttactacacatgaaataattcatgctggagagaaactctacaaatgtgaagaatgtggtgaagcttttaatcgatcctcaaatcttactacacataagataattcatactggagagaaaccttacaagtgtgaagaatgtggcaaagcatttatctggtcctcaacccttactgagcataagaaaattcatactagaaagaaaccctacaagtgtgaagaatgtggcaaagcatttatatggtcctcaacactaactagacataagaggatgcacactggagagaaaccctacaaatgtgaagaatgtggcaaagcttttagccagtcctcaacccttactacacataagataattcatactggagagaaacgctacaaatgcttagaatgtggcaaagcttttaagcaactctcaactcttactacacataaaataattcatgttggagagaaactctacaaatgtgaagaatgcggcaaaggttttaatcgatcttcaaatcttactacacataagataattcatactggagagaaaccttacaagtgtgaagaatgtggcaaagcatttatctggtcctcaacccttactaaacataagagaattcatactagagagaaaccctacaaatgtgaagaatgtggcaaggcatttatatggtcctcaaccctaactagacataagaggatgcacactggagagaaaccctacaaatgtgaagaatgtggcaaatcttttagccaatcctcaacccttactacacataagataattcatactggagagaaaccctacaaatgtgaagaatgtggcaaagcctttaactggtcctcaactcttactaaacataagataattcatactgaagagaaaccctacaaatgtgaaaaatgtggcaaagcctttaagcagtcttcaatccttactaaccataagagaattcatactggagagaaaccctataaatgtgaagaatgtggcaaatcttttaaccggtcttcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattctaattactctcagaagatctgtcagaaagtatgtctttaaagtatagaagagcatttattttgaaaaaaacattacacatatgaagaggattgtaatatctttacttgtaccacagatcttattgtacacattttatactagagaaaaaccctcaggcagttgttaaaattttgttgaacatcagggagtttaagaaaaccctgcaagtataatgaatttggaaaaacattttttcaaaaactacaaattataaaacaccaaagtgttcatactaaaatatatttttgcagatacattaaatatgaaagatattcaatccaaaattaagtctatgtaaatatcagggaataattcacagtagaaatatctagggcattcaagctttagacattacactaaatcagagtgctgagtatagaaaataatacaaacagatttgtctaaacatttgtatataactttaaaaatagaatattttttggagggttataattacattcaaagtacttttttttgaaaatacagattttttttaaaagtgaataatgtgttcaactcttaaattcatgctgtttcatcattgctggtgtattcatatgtgaaagcatgtgactaattgttgctgcataaaagatatgagattcttttttattaggcattatttatgaccttttctatgaaaagataaggacattaaaatgtaagatgcgtgaggaaaatttaggtagagaggctctttgtggttaacttataatattgagtgatgcatgaggtaggtgttcagaataatattcctctgcattattatgaatgaaaagcattcttaattttagttaaaattaagttagtcatatgttattttattaattgtacttctatgaaataatatgcagtctatttttaaattataaattatgtgtgaacttagcttttcaattcaacatttttaacatattaaatactattgtgaattcaatgaagtgttcttatgccactaactttaacctattcccttactcaaggatgtaggtaaaagatggtaacaatacactatttggtaagataatgtactgacatctctagcaatcttttttgccagtggctttaaattgccaataagttaaagaatattgttcctatgggttaaatttttattcttattttcacatttaaatttatttttcttaatttttgtggatacataatatgtgtatatatgtatgccatatatggtatattttgatgcaggcatactctatataataatcacattagaggaaatgagatatccattacctctagcatttattctttttattacaagcaattcaattgtacacttttagttatttttaaatttacaatgttattgattacagggtcatttttatggtcataataaaaaattttatacaaacgtgtaaaatctatacatttctgagttctgaataaatatttttaaaaattttaatatatttttctttgaatatgtgacctttgcctgcaagcacatatggactcttagaattgatttacataaaattaaatatatacttctattaaagataaaccttaggtgt

SEQ ID NO: 201909 - DNA, 792 bp, Homo sapiens
  Payload ID: 19832
  Gene Name: zinc finger protein 254
  ENST ID: ENST00000594886
  CDS Start-End: 133-294
gatatggcggggcctttgtctctcgctgtcgccggagtcccaggtctgtcttcactgctctgtgtcctctgctcctagaggcccagcctctgtggcgctgttaccagcaggtattggagatccacagctaagatgccaggaccccctagaagcctagaaatgatggagtctcgctctgttggccaagctggagtgcagaggcgcaatctcagctcactgcaagctctgtctcccgggttcacgccgttctcagcctctcgagcagctggaactacagggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatcttt

SEQ ID NO: 201910 - DNA, 611 bp, Homo sapiens
  Payload ID: 19832
  Gene Name: zinc finger protein 254
  ENST ID: ENST00000595187
  CDS Start-End: 56-283
gaggcccagcctctgtggcgctgttaccagcaggtattggagatccacagctaagatgccaggaccccctagaagcctagaaatgatggagtctcgctctgttggccaagctggagtgcagaggcgcaatctcagctcactgcaagctctgtctcccgggttcacgccgttctcagcctctcgagcagctggaactacagatggagtctcgctctgtcatccaggctggagtcaatggcacaatctcggctcactgcaacctctgcctcccgggttcaagtgattctcctgcctcagcctcctgagtagctgcgattacagggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggtatgtgtcctcattttgctcaagacctttggccagagcagggcatggaagattcttttcaaaaagc

SEQ ID NO: 201911 - DNA, 4244 bp, Homo sapiens
  Payload ID: 19832
  Gene Name: zinc finger protein 254
  ENST ID: ENST00000613065
  CDS Start-End: 407-2263
aatcaagcgcgcagttgaagaggagtgcatggtttccggcatttggctgggcctttgtctctcgctcccaccagagcttggaatccgtctctgctcttctgcattctccacctcgggagcccctggggactctgtgacggcctctgttgccctgtgatctgcaggtccggagagacgcacagctaagatgtcaggacatcctggaagctgggaaagggtcttgccatctctaagctggacctggtgacctttttggagggaaagaaagagccctggactgtgaagagtgaggagaccatagctgcacagccagggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcctaagcaactctcaacccttactacacatgaaataattcatgctggagagaaactctacaaatgtgaagaatgtggtgaagcttttaatcgatcctcaaatcttactacacataagataattcatactggagagaaaccttacaagtgtgaagaatgtggcaaagcatttatctggtcctcaacccttactgagcataagaaaattcatactagaaagaaaccctacaagtgtgaagaatgtggcaaagcatttatatggtcctcaacactaactagacataagaggatgcacactggagagaaaccctacaaatgtgaagaatgtggcaaagcttttagccagtcctcaacccttactacacataagataattcatactggagagaaacgctacaaatgcttagaatgtggcaaagcttttaagcaactctcaactcttactacacataaaataattcatgttggagagaaactctacaaatgtgaagaatgcggcaaaggttttaatcgatcttcaaatcttactacacataagataattcatactggagagaaaccttacaagtgtgaagaatgtggcaaagcatttatctggtcctcaacccttactaaacataagagaattcatactagagagaaaccctacaaatgtgaagaatgtggcaaggcatttatatggtcctcaaccctaactagacataagaggatgcacactggagagaaaccctacaaatgtgaagaatgtggcaaatcttttagccaatcctcaacccttactacacataagataattcatactggagagaaaccctacaaatgtgaagaatgtggcaaagcctttaactggtcctcaactcttactaaacataagataattcatactgaagagaaaccctacaaatgtgaaaaatgtggcaaagcctttaagcagtcttcaatccttactaaccataagagaattcatactggagagaaaccctataaatgtgaagaatgtggcaaatcttttaaccggtcttcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattctaattactctcagaagatctgtcagaaagtatgtctttaaagtatagaagagcatttattttgaaaaaaacattacacatatgaagaggattgtaatatctttacttgtaccacagatcttattgtacacattttatactagagaaaaaccctcaggcagttgttaaaattttgttgaacatcagggagtttaagaaaaccctgcaagtataatgaatttggaaaaacattttttcaaaaactacaaattataaaacaccaaagtgttcatactaaaatatatttttgcagatacattaaatatgaaagatattcaatccaaaattaagtctatgtaaatatcagggaataattcacagtagaaatatctagggcattcaagctttagacattacactaaatcagagtgctgagtatagaaaataatacaaacagatttgtctaaacatttgtatataactttaaaaatagaatattttttggagggttataattacattcaaagtacttttttttgaaaatacagattttttttaaaagtgaataatgtgttcaactcttaaattcatgctgtttcatcattgctggtgtattcatatgtgaaagcatgtgactaattgttgctgcataaaagatatgagattcttttttattaggcattatttatgaccttttctatgaaaagataaggacattaaaatgtaagatgcgtgaggaaaatttaggtagagaggctctttgtggttaacttataatattgagtgatgcatgaggtaggtgttcagaataatattcctctgcattattatgaatgaaaagcattcttaattttagttaaaattaagttagtcatatgttattttattaattgtacttctatgaaataatatgcagtctatttttaaattataaattatgtgtgaacttagcttttcaattcaacatttttaacatattaaatactattgtgaattcaatgaagtgttcttatgccactaactttaacctattcccttactcaaggatgtaggtaaaagatggtaacaatacactatttggtaagataatgtactgacatctctagcaatcttttttgccagtggctttaaattgccaataagttaaagaatattgttcctatgggttaaatttttattcttattttcacatttaaatttatttttcttaatttttgtggatacataatatgtgtatatatgtatgccatatatggtatattttgatgcaggcatactctatataataatcacattagaggaaatgagatatccattacctctagcatttattctttttattacaagcaattcaattgtacacttttagttatttttaaatttacaatgttattgattacagggtcatttttatggtcataataaaaaattttatacaaacgtgtaaaatctatacatttctgagttctgaataaatatttttaaaaattttaatatatttttctttgaatatgtgacctttgcctgcaagcacatatggactcttagaattgatttacataaaattaaatatatacttctattaaagataaaccttaggtgt

SEQ ID NO: 201912 - DNA, 3982 bp, Homo sapiens
  Payload ID: 19832
  Gene Name: zinc finger protein 254
  ENST ID: ENST00000611359
  CDS Start-End: 241-2001
acaaagcggcttccgggatatggcggggcctttgtctctcgctgtcgccggagtcccaggtctgtcttcactgctctgtgtcctctgctcctagaggcccagcctctgtggcgctgttaccagcaggtattggagatccacagctaagatgccaggaccccctagaagcctagaaatggtattgctgtctctaagccagacctgatcacctgtctggaacaagggaaagagccctggaatatgaagcgacatgagatggtggatgaacccccaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcctaagcaactctcaacccttactacacatgaaataattcatgctggagagaaactctacaaatgtgaagaatgtggtgaagcttttaatcgatcctcaaatcttactacacataagataattcatactggagagaaaccttacaagtgtgaagaatgtggcaaagcatttatctggtcctcaacccttactgagcataagaaaattcatactagaaagaaaccctacaagtgtgaagaatgtggcaaagcatttatatggtcctcaacactaactagacataagaggatgcacactggagagaaaccctacaaatgtgaagaatgtggcaaagcttttagccagtcctcaacccttactacacataagataattcatactggagagaaacgctacaaatgcttagaatgtggcaaagcttttaagcaactctcaactcttactacacataaaataattcatgttggagagaaactctacaaatgtgaagaatgcggcaaaggttttaatcgatcttcaaatcttactacacataagataattcatactggagagaaaccttacaagtgtgaagaatgtggcaaagcatttatctggtcctcaacccttactaaacataagagaattcatactagagagaaaccctacaaatgtgaagaatgtggcaaggcatttatatggtcctcaaccctaactagacataagaggatgcacactggagagaaaccctacaaatgtgaagaatgtggcaaatcttttagccaatcctcaacccttactacacataagataattcatactggagagaaaccctacaaatgtgaagaatgtggcaaagcctttaactggtcctcaactcttactaaacataagataattcatactgaagagaaaccctacaaatgtgaaaaatgtggcaaagcctttaagcagtcttcaatccttactaaccataagagaattcatactggagagaaaccctataaatgtgaagaatgtggcaaatcttttaaccggtcttcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattctaattactctcagaagatctgtcagaaagtatgtctttaaagtatagaagagcatttattttgaaaaaaacattacacatatgaagaggattgtaatatctttacttgtaccacagatcttattgtacacattttatactagagaaaaaccctcaggcagttgttaaaattttgttgaacatcagggagtttaagaaaaccctgcaagtataatgaatttggaaaaacattttttcaaaaactacaaattataaaacaccaaagtgttcatactaaaatatatttttgcagatacattaaatatgaaagatattcaatccaaaattaagtctatgtaaatatcagggaataattcacagtagaaatatctagggcattcaagctttagacattacactaaatcagagtgctgagtatagaaaataatacaaacagatttgtctaaacatttgtatataactttaaaaatagaatattttttggagggttataattacattcaaagtacttttttttgaaaatacagattttttttaaaagtgaataatgtgttcaactcttaaattcatgctgtttcatcattgctggtgtattcatatgtgaaagcatgtgactaattgttgctgcataaaagatatgagattcttttttattaggcattatttatgaccttttctatgaaaagataaggacattaaaatgtaagatgcgtgaggaaaatttaggtagagaggctctttgtggttaacttataatattgagtgatgcatgaggtaggtgttcagaataatattcctctgcattattatgaatgaaaagcattcttaattttagttaaaattaagttagtcatatgttattttattaattgtacttctatgaaataatatgcagtctatttttaaattataaattatgtgtgaacttagcttttcaattcaacatttttaacatattaaatactattgtgaattcaatgaagtgttcttatgccactaactttaacctattcccttactcaaggatgtaggtaaaagatggtaacaatacactatttggtaagataatgtactgacatctctagcaatcttttttgccagtggctttaaattgccaataagttaaagaatattgttcctatgggttaaatttttattcttattttcacatttaaatttatttttcttaatttttgtggatacataatatgtgtatatatgtatgccatatatggtatattttgatgcaggcatactctatataataatcacattagaggaaatgagatatccattacctctagcatttattctttttattacaagcaattcaattgtacacttttagttatttttaaatttacaatgttattgattacagggtcatttttatggtcataataaaaaattttatacaaacgtgtaaaatctatacatttctgagttctgaataaatatttttaaaaattttaatatatttttctttgaatatgtgacctttgcctgcaagcacatatggactcttagaattgatttacataaaattaaatatatacttctattaaagataaaccttaggtgt

SEQ ID NO: 201913 - DNA, 3886 bp, Homo sapiens
  Payload ID: 19832
  Gene Name: zinc finger protein 254
  ENST ID: ENST00000616028
  CDS Start-End: 181-1905
acaaagcggcttccgggatatggcggggcctttgtctctcgctgtcgccggagtcccaggtctgtcttcactgctctgtgtcctctgctcctagaggcccagcctctgtggcgctgttaccagcaggtattggagatccacagctaagatgccaggaccccctagaagcctagaaatggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcctaagcaactctcaacccttactacacatgaaataattcatgctggagagaaactctacaaatgtgaagaatgtggtgaagcttttaatcgatcctcaaatcttactacacataagataattcatactggagagaaaccttacaagtgtgaagaatgtggcaaagcatttatctggtcctcaacccttactgagcataagaaaattcatactagaaagaaaccctacaagtgtgaagaatgtggcaaagcatttatatggtcctcaacactaactagacataagaggatgcacactggagagaaaccctacaaatgtgaagaatgtggcaaagcttttagccagtcctcaacccttactacacataagataattcatactggagagaaacgctacaaatgcttagaatgtggcaaagcttttaagcaactctcaactcttactacacataaaataattcatgttggagagaaactctacaaatgtgaagaatgcggcaaaggttttaatcgatcttcaaatcttactacacataagataattcatactggagagaaaccttacaagtgtgaagaatgtggcaaagcatttatctggtcctcaacccttactaaacataagagaattcatactagagagaaaccctacaaatgtgaagaatgtggcaaggcatttatatggtcctcaaccctaactagacataagaggatgcacactggagagaaaccctacaaatgtgaagaatgtggcaaatcttttagccaatcctcaacccttactacacataagataattcatactggagagaaaccctacaaatgtgaagaatgtggcaaagcctttaactggtcctcaactcttactaaacataagataattcatactgaagagaaaccctacaaatgtgaaaaatgtggcaaagcctttaagcagtcttcaatccttactaaccataagagaattcatactggagagaaaccctataaatgtgaagaatgtggcaaatcttttaaccggtcttcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattctaattactctcagaagatctgtcagaaagtatgtctttaaagtatagaagagcatttattttgaaaaaaacattacacatatgaagaggattgtaatatctttacttgtaccacagatcttattgtacacattttatactagagaaaaaccctcaggcagttgttaaaattttgttgaacatcagggagtttaagaaaaccctgcaagtataatgaatttggaaaaacattttttcaaaaactacaaattataaaacaccaaagtgttcatactaaaatatatttttgcagatacattaaatatgaaagatattcaatccaaaattaagtctatgtaaatatcagggaataattcacagtagaaatatctagggcattcaagctttagacattacactaaatcagagtgctgagtatagaaaataatacaaacagatttgtctaaacatttgtatataactttaaaaatagaatattttttggagggttataattacattcaaagtacttttttttgaaaatacagattttttttaaaagtgaataatgtgttcaactcttaaattcatgctgtttcatcattgctggtgtattcatatgtgaaagcatgtgactaattgttgctgcataaaagatatgagattcttttttattaggcattatttatgaccttttctatgaaaagataaggacattaaaatgtaagatgcgtgaggaaaatttaggtagagaggctctttgtggttaacttataatattgagtgatgcatgaggtaggtgttcagaataatattcctctgcattattatgaatgaaaagcattcttaattttagttaaaattaagttagtcatatgttattttattaattgtacttctatgaaataatatgcagtctatttttaaattataaattatgtgtgaacttagcttttcaattcaacatttttaacatattaaatactattgtgaattcaatgaagtgttcttatgccactaactttaacctattcccttactcaaggatgtaggtaaaagatggtaacaatacactatttggtaagataatgtactgacatctctagcaatcttttttgccagtggctttaaattgccaataagttaaagaatattgttcctatgggttaaatttttattcttattttcacatttaaatttatttttcttaatttttgtggatacataatatgtgtatatatgtatgccatatatggtatattttgatgcaggcatactctatataataatcacattagaggaaatgagatatccattacctctagcatttattctttttattacaagcaattcaattgtacacttttagttatttttaaatttacaatgttattgattacagggtcatttttatggtcataataaaaaattttatacaaacgtgtaaaatctatacatttctgagttctgaataaatatttttaaaaattttaatatatttttctttgaatatgtgacctttgcctgcaagcacatatggactcttagaattgatttacataaaattaaatatatacttctattaaagataaaccttaggtgt

SEQ ID NO: 201914 - DNA, 2172 bp, Homo sapiens
  Payload ID: 19833
  Gene Name: zinc finger protein 256
  Uniprot ID: Q9Y2P7
  ENST ID: ENST00000282308
  CDS Start-End: 198-2081
ggcatttgtctggactgattacttggtagaaagccccggagcgctgggtcagcatcatccgtgactgactgagaaggcgcgagaggagtcttccccgctgcacagaggcgtggctgaggctcggcggcgcccagggtacccaggcccggcccggaataaggacatcctctctggccccgctccgctcacagagtcagatggcggcggccgagctgacggccccggcccagggcattgtgacctttgaggacgtggctgtttacttctcctggaaggagtggggtcttcttgatgaggctcagaaatgcctgtaccacgatgtgatgctggagaacttgacacttacaacctccctgggtggttctggagcaggggatgaggaggcaccttatcagcagagcacttctccacagcgggtgtcacaggttaggattcctaaggcccttccttctccccagaagaccaacccctgtgagatatgtggcccagtcttgagacagattttgcacttggttgaacaccaaggaacacaccatggtcagaaactgtatacagacggggcatgtaggaaacaattacaatttactgcataccttcatcagcaccagaagcagcatgttggacagaaacacttcagaagcaatgggggcagagacatgtttttgagcagctgcacatttgaagtatctgggaagcccttcacttgcaaggaggttgggaaggatttcctggtgagatcaagatttcttcagcaacaggctgctcacaccagaaagaagtcaaacagaaccaagagtgcagtggcctttcacagtgtaaaaaatcattacaactggggagaatgtgtgaaagctttcagctacaaacatgtacgtgttcagcaccagggagacctcattagggaaagatcttacatgtgcagtgaatgtgggaaatcttttagcacaagctgtagcctcagtgatcatttgagagttcacacttcagaaaagccttatacatgtggagaatgtgggaaatcctataggcaaagctctagccttattacgcaccgaagaattcacactggagtaagacctcatcaatgtgatgaatgtggaaaattatttaacaggaagtatgaccttcttatacatcagagagttcatactggagaaaggccttacaagtgcagtgaatgtgggaaatcctttagccatagctctagcctcattacacaccagagaattcatactggaatgaggccttatgagtgcagtgaatgtgggaaatcttttatccatagttctagccttattacacaccagagagttcacactggtacaaggccttatatgtgcagtgaatgtgggaaatcctttagccagagctgtcacctcattaaacaccggagacttcacattggagaagggccttatgagtgtagtgaatgtgggaaattgtttacttatagatctcgtttcttccaacaccagagagttcatactggagtaagatctcatgaatgtcatgaatgtggaaaattatttagcaggaaatttgacctcattgtacatgagagagttcacacaggagaaaggccatatgagtgcagtgaatgtggaaaatcctttacctgtaaatcctacctcatctcacactggaaagttcatactggagcaaggccttatgaatgtggggagtgtgggaaatcatttactcatagctctacgctccttcaacaccagagagttcacactggagaaaggccttatgagtgcaatgaatgtgggaagttttttagccagagctccagcctcattagacataggagaagtcacaccggagaaaggccttatgagtgcagtgagtgttggaaatcctttagtaaccactctagcctcgttaaacaccgaagagttcataccggagaaaggccttatgaatgcagtgaatgtggaaaatcctttagccagagctctaacctcactaatcaccagcgaattcacagtggggaaaggccttatgagtgtagtgactgtggaaaattttttaccttcaactccaacctcctaaaacatcagaacgttcacaagggataaaggttaggtaacacacatagggctgttacggactgagaagtgtccctgcaaaattcacagacataaataaataaatacgtattttcaataa

SEQ ID NO: 201915 - DNA, 1958 bp, Homo sapiens
  Payload ID: 19833
  Gene Name: zinc finger protein 256
  ENST ID: ENST00000598928
  CDS Start-End: 202-372
ttttggcatttgtctggactgattacttggtagaaagccccggagcgctgggtcagcatcatccgtgactgactgagaaggcgcgagaggagtcttccccgctgcacagaggcgtggctgaggctcggcggcgcccagggtacccaggcccggcccggaataaggacatcctctctggccccgctccgctcacagagtcagatggcggcggccgagctgacggccccggcccaggtggttctggagcaggggatgaggaggcaccttatcagcagagcacttctccacagcgggtgtcacaggttaggattcctaaggcccttccttctccccagaagaccaacccctgtgagatatgtggcccagtcttgagacagattttgcacttggttgaacaccaaggaacacaccatggtcagaaactgtatacagacggggcatgtaggaaacaattacaatttactgcataccttcatcagcaccagaagcagcatgttggacagaaacacttcagaagcaatgggggcagagacatgtttttgagcagctgcacatttgaagtatctgggaagcccttcacttgcaaggaggttgggaaggatttcctggtgagatcaagatttcttcagcaacaggctgctcacaccagaaagaagtcaaacagaaccaagagtgcagtggcctttcacagtgtaaaaaatcattacaactggggagaatgtgtgaaagctttcagctacaaacatgtacgtgttcagcaccagggagacctcattagggaaagatcttacatgtgcagtgaatgtgggaaatcttttagcacaagctgtagcctcagtgatcatttgagagttcacacttcagaaaagccttatacatgtggagaatgtgggaaatcctataggcaaagctctagccttattacgcaccgaagaattcacactggagtaagacctcatcaatgtgatgaatgtggaaaattatttaacaggaagtatgaccttcttatacatcagagagttcatactggagaaaggccttacaagtgcagtgaatgtgggaaatcctttagccatagctctagcctcattacacaccagagaattcatactggaatgaggccttatgagtgcagtgaatgtgggaaatcttttatccatagttctagccttattacacaccagagagttcacactggtacaaggccttatatgtgcagtgaatgtgggaaatcctttagccagagctgtcacctcattaaacaccggagacttcacattggagaagggccttatgagtgtagtgaatgtgggaaattgtttacttatagatctcgtttcttccaacaccagagagttcatactggagtaagatctcatgaatgtcatgaatgtggaaaattatttagcaggaaatttgacctcattgtacatgagagagttcacacaggagaaaggccatatgagtgcagtgaatgtggaaaatcctttacctgtaaatcctacctcatctcacactggaaagttcatactggagcaaggccttatgaatgtggggagtgtgggaaatcatttactcatagctctacgctccttcaacaccagagagttcacactggagaaaggccttatgagtgcaatgaatgtgggaagttttttagccagagctccagcctcattagacataggagaagtcacaccggagaaaggccttatgagtgcagtgagtgttggaaatcctttagtaaccactctagcctcgttaaacaccgaagagttcataccggagaaaggccttatgaatgcagtgaatgtggaaaatcctttagccagagctctaacctcactaatcaccagcgaattcacagtggggaaaggccttatgagtgtagtgactgtggaaaattttttaccttcaactccaacctcctaaaacatcagaacgttcacaagggataa

SEQ ID NO: 201916 - DNA, 3655 bp, Homo sapiens
  Payload ID: 19834
  Gene Name: zinc finger protein 257
  ENST ID: ENST00000435820
  CDS Start-End: 182-289
agcggacagggtggcttccgggtttggcgggtactttgtctctcgctctagcccgagctgcaggtctcgtcttccctggtctgtgtcctcttctcctaggggcccagcctctgtggccctgtgacctgcaggtattgggagatccccagctaagacgccaggtcctcctggaagcctagaaatgatggagtcttgctctgtcgtcagactggagtgcagtgggatgatctcggctctctgcaacctccgcctcccaggttcaagcaattctcctgcctcagcctcctgagtagctgggattacagggaccactgacaattagggatgtgactgtagaattctctctggaggagtggcattgcctggacactgcacagcagaatttatatagggatgtgatgttagagaactacagaaacctggtcttcctgggtattgctgtctctaagccagacctgatcacctgtctggagcaaggaaaagagccctgtaatatgaagagacatgagatggtagccaaacccccagttatgtgttctcatattgctgaagacctttgcccagagcgagacataaaatattttttccaaaaagtcatactgaggagatatgataaatgtgaacatgagaatttacaattaagaaagggctgtaaaagtgtggatgagtgtaaggtgtgcaaaggaggttataatggacttaaccaatgtctgataactacccagagcaaaatgtatcaatgtgataaatatgtaaaagtcttctataagttttcaaattcagatagacataagataagacatactgaaaagaaaacttgcaaatgtaaagaatgtggcaaatcattttgcatgctttcacaactaactcgacataagagaattcatattagagagaattcccacaaatgtgaagaatgtggcaaagcctttaaccagtcctcagctcttactcgacataagatgactcatactggagagaaaccctacaaatgtgaagagtgtggaaaagcttttaaccggtcttcacaccttactcaacataaggtaattcatactagagagaaaccctacaaatgtgaagagtgtggcaaagcctttaaccggtcttcacacattactcaacataagagaattcataatagagagaagcccttcaaatatgatgaatgttgcaaagcctttaagtggtcctcagctcttactacccttactcaacataagagaattcatactggagagaaaccctacaaatgtgaagagtgtggcaaagcctttaaccagtcctcagcccttactcgacataagatgattcatactggagagaaacccttccaatgtgaagagtgtggcaaagcttttaaccggtcttcacaccttactcaacataagataattcatactaaagagaaaccctacaaatgtgaagagtgtggaaaagcctttaaccggtcttcacaccttactaaacataagagaattcatactagagagaaggcctacaaatgtgatgaatattgcaaagcttttaactggtcctcagctcttactacccttactcagcataagataattcatactggagagaaaccctacaaatgtgaagagtgtggcaaagcctttaaccggtcttcataccttattcgacataagataattcatactggagagaaaccctacaaatgtgaagagtgtggcaaagcctttaaccagtcttcacaccttactcaacataaaataattcatactggggagaagccctacaaatgtgaagaatgtggcaaagcctttaaccggtcttcacacctttctcaacataagataattcatactggagagaaaccctacaaatgtgaagaatgtggcaagccttttaatcgtttctcataccttaccgtacataagagaattcatgctggagagaaccccaacaaatatgaagaatgtggcaaagcttgtaaccattcctcaaaccttactaaacataattcataatggagaaaaaccctacaaatgtgaagaatgtgtcaaagcttttaactgttcctcaatccttactaaacataagggaattcataatagagaaaccctacaaatgtgaagaacgtggcctggcttttaacaaatcctcaacatttactaagcataaaataattcatgctggagagaaactcttgaaatgtgatgaatgtggcatagcctcttcccagttctcaactcttactaaacatgagaacacatgtggaagataaagcctacaaatatgaagaatgtgacaaggcctttaaaagttctcaacccttattacacataatttatactggacagaaatcctaaagtgtgaagaatgtcacaaagcccttaataagtcctcaattcttaacagatataagatgtttcatactggagcgaaactacaatcctgaatgatgtcacagtgcttttaacaatacctcaaacttttctaaacataaaaaaaaattatactagtgcgaaactctagaaatataaagaacatgaaaaacttttaaatggttttcacacttgattgcaggtaaaataatttataccggagaaaactccaagtgtgaagaatataacttttaaccagtgttcacaacttattgtacaggaaagcatttatagttgagaaatggtgtacaaatataaagaatgtggaaaagtcattaatatttgctcacatattacacatcagagagttcatacttaataaaagtattataaatacaattactgtcaaatgatctttcagaaatataaacctttaaagtgaagaagagttcattctaaagacaaacattacaaatataaaggggtttgtagtgcttttacttgtatcacagattttattgtacacattttgtactagagaataaccctgaagcagttgctaaaattttgttcagcattaggaaatttatgttggagaagaattcagcaagtgtgattaatttggaaaaacattttttccataactatagcttagaaaatgccagagagctcatactaaaatatacttttgcagatgcaataaatacaaagaaatatttaattcaaattgagtttatataattatcagagaattaacagtagaaatagctaaggcactgacacttcagacattacactaaatcagattgctgagtatagaaaatccaaaactacagttggtaagtaaattaattttatgtaactttaaaatgagtagacatttctttgagaagtcataattaaattcaagtatacttttttgataaaattataaagctttttaaaagtaaataatgatgtaagtcaactctcaaattacttcatgctgtttcttcatttctattgtattcacctgtgaaagcatgtgatcaactattgctgcatcagagatatgagagatactttattaggtgggaattatatacgacctcttctataaaatagtaaggacactgaaatataagatgcataagagtctaagtgaagaggttctttgtggttaacttagtgatgtatgaagtagttgctcatgttatgagagaaaaacatttttaattttagttaaatgtaagttaaaattaaaatagtaccatataatgttagtgattgtacttttatttaataaaatgcagtacattttaaaa

SEQ ID NO: 201917 - DNA, 557 bp, Homo sapiens
  Payload ID: 19834
  Gene Name: zinc finger protein 257
  ENST ID: ENST00000594363
  CDS Start-End: 150-557
actttgtctctcgctctagcccgagctgcaggtctcgtcttccctggtctgtgtcctcttctcctaggggcccagcctctgtggccctgtgacctgcaggtattgggagatccccagctaagacgccaggtcctcctggaagcctagaaatgggaccactgacaattagggatgtgactgtagaattctctctggaggagtggcattgcctggacactgcacagcagaatttatatagggatgtgatgttagagaactacagaaacctggtcttcctgggtattgctgtctctaagccagacctgatcacctgtctggagcaaggaaaagagccctgtaatatgaagagacatgagatggtagccaaacccccagatggaggttcactcttcttgcccagactgaagtgcaatggtgcagtctcagctcaccgtaaactcctcctcccgggttcaagcgattctcttgcctcagcctttcaagtagcagggattacaggcactcgccaccatgcctggctaatttttgtatttttagtagacatggggtttcaccat

SEQ ID NO: 201918 - DNA, 817 bp, Homo sapiens
  Payload ID: 19834
  Gene Name: zinc finger protein 257
  ENST ID: ENST00000600162
  CDS Start-End: 98-346
gtcctcttctcctaggggcccagcctctgtggccctgtgacctgcaggtattgggagatccccagctaagacgccaggtcctcctggaagcctagaaatgggaccactgacaattagggatgtgactgtagaattctctctggaggagtggcattgcctggacactgcacagcagaatttatatagggatgtgatgttagagaactacagaaacctggtcttcctgggtattgctgtctctaagccagacctgatcacctgtctggagcaaggaaaagagccctgtaatatgaagagacatgagatggtagccaaacccccagcattttatttaatgggagaatgaaaccagtgtcttgaaagacccctaaaagccagacatagaaatttatgtgttctcatattgctgaagacctttgcccagagcgagacataaaatattttttccaaaaagtcatactgaggagatatgataaatgtgaacatgagaatttacaattaagaaagggctgtaaaagtgtggatgagtgtaaggtgtgcaaaggaggttataatggacttaaccaatgtctgataactacccagagcaaaatgtatcaatgtgataaatatgtaaaagtcttctataagttttcaaattcagatagacataagataagacatactgaaaagaaaacttgcaaatgtaaagaatgtggcaaatcattttgcatgctttcacaactaactcgacataagagaattcatattagagagaattcccacaaatgtgaagaatgtggcaaagcctttaaccagtcctcagctcttactcgac

SEQ ID NO: 201919 - DNA, 3874 bp, Homo sapiens
  Payload ID: 19834
  Gene Name: zinc finger protein 257
  Uniprot ID: Q9Y2Q1
  ENST ID: ENST00000594947
  CDS Start-End: 145-1836
gtctctcgctctagcccgagctgcaggtctcgtcttccctggtctgtgtcctcttctcctaggggcccagcctctgtggccctgtgacctgcaggtattgggagatccccagctaagacgccaggtcctcctggaagcctagaaatgggaccactgacaattagggatgtgactgtagaattctctctggaggagtggcattgcctggacactgcacagcagaatttatatagggatgtgatgttagagaactacagaaacctggtcttcctgggtattgctgtctctaagccagacctgatcacctgtctggagcaaggaaaagagccctgtaatatgaagagacatgagatggtagccaaacccccagttatgtgttctcatattgctgaagacctttgcccagagcgagacataaaatattttttccaaaaagtcatactgaggagatatgataaatgtgaacatgagaatttacaattaagaaagggctgtaaaagtgtggatgagtgtaaggtgtgcaaaggaggttataatggacttaaccaatgtctgataactacccagagcaaaatgtatcaatgtgataaatatgtaaaagtcttctataagttttcaaattcagatagacataagataagacatactgaaaagaaaacttgcaaatgtaaagaatgtggcaaatcattttgcatgctttcacaactaactcgacataagagaattcatattagagagaattcccacaaatgtgaagaatgtggcaaagcctttaaccagtcctcagctcttactcgacataagatgactcatactggagagaaaccctacaaatgtgaagagtgtggaaaagcttttaaccggtcttcacaccttactcaacataaggtaattcatactagagagaaaccctacaaatgtgaagagtgtggcaaagcctttaaccggtcttcacacattactcaacataagagaattcataatagagagaagcccttcaaatatgatgaatgttgcaaagcctttaagtggtcctcagctcttactacccttactcaacataagagaattcatactggagagaaaccctacaaatgtgaagagtgtggcaaagcctttaaccagtcctcagcccttactcgacataagatgattcatactggagagaaacccttccaatgtgaagagtgtggcaaagcttttaaccggtcttcacaccttactcaacataagataattcatactaaagagaaaccctacaaatgtgaagagtgtggaaaagcctttaaccggtcttcacaccttactaaacataagagaattcatactagagagaaggcctacaaatgtgatgaatattgcaaagcttttaactggtcctcagctcttactacccttactcagcataagataattcatactggagagaaaccctacaaatgtgaagagtgtggcaaagcctttaaccggtcttcataccttattcgacataagataattcatactggagagaaaccctacaaatgtgaagagtgtggcaaagcctttaaccagtcttcacaccttactcaacataaaataattcatactggggagaagccctacaaatgtgaagaatgtggcaaagcctttaaccggtcttcacacctttctcaacataagataattcatactggagagaaaccctacaaatgtgaagaatgtggcaagccttttaatcgtttctcataccttaccgtacataagagaattcatgctggagagaaccccaacaaatatgaagaatgtggcaaagcttgtaaccattcctcaaaccttactaaacataattcataatggagaaaaaccctacaaatgtgaagaatgtgtcaaagcttttaactgttcctcaatccttactaaacataagggaattcataatagagaaaccctacaaatgtgaagaacgtggcctggcttttaacaaatcctcaacatttactaagcataaaataattcatgctggagagaaactcttgaaatgtgatgaatgtggcatagcctcttcccagttctcaactcttactaaacatgagaacacatgtggaagataaagcctacaaatatgaagaatgtgacaaggcctttaaaagttctcaacccttattacacataatttatactggacagaaatcctaaagtgtgaagaatgtcacaaagcccttaataagtcctcaattcttaacagatataagatgtttcatactggagcgaaactacaatcctgaatgatgtcacagtgcttttaacaatacctcaaacttttctaaacataaaaaaaaattatactagtgcgaaactctagaaatataaagaacatgaaaaacttttaaatggttttcacacttgattgcaggtaaaataatttataccggagaaaactccaagtgtgaagaatataacttttaaccagtgttcacaacttattgtacaggaaagcatttatagttgagaaatggtgtacaaatataaagaatgtggaaaagtcattaatatttgctcacatattacacatcagagagttcatacttaataaaagtattataaatacaattactgtcaaatgatctttcagaaatataaacctttaaagtgaagaagagttcattctaaagacaaacattacaaatataaaggggtttgtagtgcttttacttgtatcacagattttattgtacacattttgtactagagaataaccctgaagcagttgctaaaattttgttcagcattaggaaatttatgttggagaagaattcagcaagtgtgattaatttggaaaaacattttttccataactatagcttagaaaatgccagagagctcatactaaaatatacttttgcagatgcaataaatacaaagaaatatttaattcaaattgagtttatataattatcagagaattaacagtagaaatagctaaggcactgacacttcagacattacactaaatcagattgctgagtatagaaaatccaaaactacagttggtaagtaaattaattttatgtaactttaaaatgagtagacatttctttgagaagtcataattaaattcaagtatacttttttgataaaattataaagctttttaaaagtaaataatgatgtaagtcaactctcaaattacttcatgctgtttcttcatttctattgtattcacctgtgaaagcatgtgatcaactattgctgcatcagagatatgagagatactttattaggtgggaattatatacgacctcttctataaaatagtaaggacactgaaatataagatgcataagagtctaagtgaagaggttctttgtggttaacttagtgatgtatgaagtagttgctcatgttatgagagaaaaacatttttaattttagttaaatgtaagttaaaattaaaatagtaccatataatgttagtgattgtacttttatttaataaaatgcagtacattttaaaatttttagattatttgtggacttaatttataattaaatattttcttttaccacgttaagactattgtacgttcaggccgggcacagtagctcacgcctgtaatcccaacactttgggaggctgaggcgggcggatcaattgaggccaggagtttgaaaccagcctggccaacatggtgaaaccctgtctctactgaaaatacaaaaaattagccaggcatggtggtgggtgcctgaaatcccagctatttgggagattgaggcaagagaatcacgtgtacccaggaggcagaggttgcagtgagccaagatcacgacattgcactccagcctaggcaacaagagcaagacttcgtctcaaaaaaaaaaaaaaaaaaaa

SEQ ID NO: 201920 - DNA, 552 bp, Homo sapiens
  Payload ID: 19834
  Gene Name: zinc finger protein 257
  ENST ID: ENST00000597927
  CDS Start-End: 155-552
actttgtctctcgctctagcccgagctgcaggtctcgtcttccctggtctgtgtcctcttctcctaggggcccagcctctgtggccctgtgacctgcaggtattgggagatccccagctaagacgccaggtcctcctggaagcctagaaatgttatgtgttctcatattgctgaagacctttgcccagagcgagacataaaatattttttccaaaaagtcatactgaggagatatgataaatgtgaacatgagaatttacaattaagaaagggctgtaaaagtgtggatgagtgtaaggtgtgcaaaggaggttataatggacttaaccaatgtctgataactacccagagcaaaatgtatcaatgtgataaatatgtaaaagtcttctataagttttcaaattcagatagacataagataagacatactgaaaagaaaacttgcaaatgtaaagaatgtggcaaatcattttgcatgctttcacaactaactcgacataagagaattcatattagagagaattcccacaaatgtgaagaatgtggcaaagc

SEQ ID NO: 201921 - DNA, 967 bp, Homo sapiens
  Payload ID: 19834
  Gene Name: zinc finger protein 257
  ENST ID: ENST00000597796
  CDS Start-End: 125-232
ctgcaggtctcgtcttccctggtctgtgtcctcttctcctaggggcccagcctctgtggccctgtgacctgcaggtattgggagatccccagctaagacgccaggtcctcctggaagcctagaaatgatggagtcttgctctgtcgtcagactggagtgcagtgggatgatctcggctctctgcaacctccgcctcccaggttcaagcaattctcctgcctcagcctcctgagtagctgggattacagggaccactgacaattagggatgtgactgtagaattctctctggaggagtggcattgcctggacactgcacagcagaatttatatagggatgtgatgttagagaactacagaaacctggtcttcctgggtattgctgtctctaagccagacctgatcacctgtctggagcaaggaaaagagccctgtaatatgaagagacatgagatggtagccaaacccccaggtaaagagaactggccataaactgtggcccaggaagctggaactgagactttgaactgcttcaggcaccacattaaaagccagggtctgcaggcctgcctgcatggctgtaaacgggtgtcttcctccaggcctgtgaaaggacagaacctctcccagactgcggctgaaaggattttgaaataattacagagtaaattcagaattctcagtgggaccaagtagcgttggccatttcctgtcctgtagccaagaccaggggtcctgtagtttgccaccaaaatgagagcctgctttctgaagagaacacccctcaatctttggctttagcagaatttcacaacttcatccctggactttaaagatctcttaaaggcatttattttggagatggggtcttgctacataacccaggctggtcttgaaatcttggcctgaagcaattctccaaccttaatataccatgtagctgtcattacaggtttgagccatgaggc

SEQ ID NO: 201922 - DNA, 17601 bp, Homo sapiens
  Payload ID: 19835
  Gene Name: zinc finger protein 26
  Uniprot ID: P17031
  ENST ID: ENST00000328654
  CDS Start-End: 378-1979
gtggccgcggaggcgcggagctaagcggctcggattatcctgggcagaccagagacttgaccagctaaacacttccgtcggtccggggcgtggacggggccagatcagcctcctgctctcccgagtcagggccacggaaaggcacaaatccatccgtgcgactcctggtacccagaccgggaggttgtctagtcacgcgcggtctgtgttgggcgagagctgaggagccggcgtccctgccaacgactcggccccgggacggtcaggagcctggggccctggtcccgcacctgtcttcgggcggacgcatccctcacggtctctccgcagcccgcgggtcctgcccccgcaggcagcgcgcgaacgtgggcgtggggatggccaccagtttccggacagcttcgtgctggggattattgtcattcaaggatatatctatggagttcacctgggatgaatggcagctactggattctacacagaagtacctgtacagagatgtgatattggaaaactatcataacctgatatcagtggggtatcatggtaccaagcctgacttaatcttcaagttggaacaaggagaagatccatggataataaatgccaaaatttccaggcagagctgtccagatggctgggaagaatggtaccagaacaatcaagatgagcttgagagtattgaaagaagctatgcttgtagtgtgttgggaagacttaatctgagcaaaacccatgattcttcaagacagagactctataacacacgtggaaaaagtttgacacaaaactcagctccaagcagaagttatttaagaaagaatcctgataagtttcatggttatgaagaaccatattttcttaagcatcaaagagctcatagcatagaaaaaaactgtgtgtgtagtgaatgtgggaaagcttttcgttgtaagtcacagctcattgtacatctcagaattcatacaggagagagaccttatgaatgcagtaaatgtgaaagagccttcagtgccaagtcaaaccttaatgctcatcagagagttcatacaggagaaaaaccctactcatgtagtgagtgcgagaaggtcttctctttcaggtcacagctcattgtccatcaggaaattcacacaggagggaaaccctatggctgcagtgaatgtgggaaagcctacagttggaaatcacagcttcttttacaccagagaagtcacacaggagtgaaaccgtatgaatgcagcgaatgtgggaaagcctttagtttgaagtctccattcgttgtacaccagagaactcatacaggagtgaaaccccataaatgcagtgaatgtgggaaagcctttaggagtaagtcctatctccttgttcacatccgaatgcatacaggagaaaaaccctatcaatgcagtgattgtgggaaagccttcaatatgaagacacaactcattgtacatcagggagttcacacaggaaataatccttatcaatgcggtgaatgtgggaaagcctttggtaggaaggaacagctcactgcacatctgagagctcatgcaggagagaagccctatggatgcagtgaatgtgggaaggctttcagcagcaagtcataccttgttatacataggagaacacacaccggagagagaccctatgaatgtagtttgtgtgagagagccttttgtggaaaatcacagctgattatacatcagagaactcattcaactgagaagccctatgaatgcaatgaatgtgaaaaagcctaccctaggaaggcatcacttcagatacaccagaaaactcattcgggagagaaaccttttaaatgcagtgaatgtggaaaagccttcactcagaagtcatctctcagtgaacatcagagagttcacaccggagagaaaccatggaaatgctctgaatgtgggaaatccttctgttggaattcagggcttcgtatacatcggaagactcataaatgagaaatcagaatgatgcaatgtgagaaactgatgttcaggagacttcggataatatagacaggatttacaagcaggaggccctaaaattacactcatgtcaaaaatcagagaggagagagaccaaccatatttgggatgagtgtaaaagctttcagaaataagttacaaatctttgtagatgaaaataatggaaggaatgtggagcaataaatgtatcaaatgttgtagtatcatcatgaagattcagagaatttacactaggaacaccttataagttgaataaattaaggaagcattttcccattgaaagtgtgttccatggaaagtcacattccagatttgaagctgtgtttttgtaaaataaaatcttggtatgaacagttgacttcatggtggagtataaagttgtttttttaaaaatatgtaaataatgttcaggaaaaacgcagggaacagagtcttaaagttaatggatatttaatgtgactttcctgagttaacactgaatagtatttctaaaattttttgtactttattttttaatgtaacttgttctatctatctatatatatatttgatagtttgtggaataatatcccccagtattttccatattaaatgctaattatcttttgatttctttttcataagcagatctggcatttattacagggctgccgcttaagagaactcattataatgaacgtttattatattttgcagttccatgcctgttgtccattgattgacatgagcacccctgttttctctggagaaatacctcccctctctggggtgcttcctgtggtagtgtctttcaggtatccgttccactagctacaggtgagcattttacccattgttggataatggtaatctctttttcagaattttgagtctgtaattcatttgtacatgaaccagaaaatgtgggaactcattcattcttgtcccagaattctgttgagaacatccattcattctggctaattgattacaagaataactgtggatacgatccctttagaacctgcttctctgatctgtgtgtttcctcacttctcaataaaaatgtcttttgctttttgttgtttgggtttttttttttttttttttttttttttttttgagactaagtttcactcttgtcctccaggctggaatgcaatggcatgatctcagctcactgcaacttccacctcctgggttcaagcaatttccttgcctcagcctcccaagtggctaggattacatgcctggctaatatttgtatttttagtatagacggggtttcaccatgttggccaggctggtcttgaactcctgacctcaggtgatctgcccacttcagcctcccaaagtcatgggattacaggtgtgagccaccgagcccggccagctttctatttcttataacctaagggctttaactgatcagttgttgccttggtagcatgtagttaacaaagtggggtatatgatttaggtttgtttgtttttcctgagacaagaaaatcacattcttgtttatatttgaagatagcaacttttagccatcatgtgaaatatggttattgtttctgtacacctggaacgttgtagtgcctgatactgaaattttggaaacactgaagaattatagcattataagaattttaaatttatgagaaaatctgagacaggggcagagatggctgattttgatcttgctggatcttagaccatgagaatgacaggcctgaagccctgaaatctcacctcagggtggagtgtcagacttggcaactttgacattgctgaaaaagtttcttacagctgtaggagtgaggtggtgggaatcaaatagtatatttggcttggtgaattaaagtcagttcacctcaaatgtttactaaatcccttaatgtaaacatgtgttgaaaaagttatcctcacccttccccccctcaaaaagttatcccttgataatttgaataggaatatctgggaagaacctgaggactcagcctagcaagctcttgtgatagactttgaatagcagtatctgcgaagaacctgaggcctcagcctagcaaactcttctgatagactttgaataggaatgtctgggaagaacctgaggactcagcctagcaaactcttctgatagactttgaataggagtatctgggaagaacctgaggactcagcctagcaaactcttctgatagactttgaataggaatgtctgggaagaacctgaggactcagcctagcaaactcttctgatagactttgaataggagtatctgggaagaacctgaggactcagcctagcaaactcttctgatagactttgcactgcagatgcttcatttaaggctatagagtagatgttggcaatatataaaattcaaacttgagtgtccataaataactgttgttggaacatggctaaatatatttgtgtattatttgactgcttttgcacagccatggcacagttgagtagttgaggtataaaaaacctgccacctcctgatacagatagaaccccttcccttttctgggaaaatgtggaatttgccttgcaggaggaagcttattctgccagttccccatggcttatttttaccagtttggtaacaataatctacactaaacatgccctgggatgggattgctcatttaggaaaatatgtagaattcatagagcattgcaggaatgagtaatgtatcaaaacttctcagcatgacaacacccagggcaacgtgacaaaaccctgtctacaaaagtttcttaaaagctggttacagcggtgcacacctgcaatcccagctactcaggaggttgaggcaggaggatcacttgagcccaggaggtcaaggatgcagtgagctgcactgtactccagtctgggcaacagtgagaccctgtctcaaaaaaaaagttgggggagggggtagatacttgtgaaatcctttgagggtgttcagtgaagggcaattacttacagcatatacttggtgcactgacacccagcagtgatgatggttttgctttctgtttttttttttgttttgttttgtttttttttttttttgagacggagtcttgttctgtcacccaggctggagtgaattgcacaatctcggctcactgcaacctccgcctcctgggttcaagcgattctcctgcctcagcctccatagtagctgggattacaggtgtgtgccaccgcgcctggctaatttttgtatttttagtagagacggggtttcaccacgttggccaggctggtcttgaattcctgacctcaggtaatccacctgcctcggcctcccgaagtgccgggattacaggcgtgagccaccatgcctgaccatgatgatggttttaaaagttagctgtagcagctaaggcaagaccagatccaacactggcttatggcaaggggaagaacaaaagtcaggaactttgccataatctagaagaaagaatgataatgctttgtgacatgctggattgtatccattatgtgttcctaagaccctcagccctctccctccaccaagacccaataaaagtgtgttattgaaagtagtagctactggccgggcgtggtggctcacgcctgtaatcccagcactttgggaggccaaggtgggtggatcacaaggtcgggagttcgagttcagcctggccaatatggtgaaatcccgtctcaactaaaaatacaaaaattagtcgggcatggtggcgggcgcctgtaatcccagctacttgggaggctgaggcaggagaatcgctggaacccgggaggtggaggtggcagtgagcagagattgcgccattgcactccagcctgggtgacagagtgagactctgtctcaaaaaaaaaaaaaaaaagaaaagaaaatgacaaacacatgttctgtgtatatgacacaatcctaactgtggcatgtatctatgtcttcacttgcatcggcctcaattatcaacttgtggcaaaagaataagaaagagaactaaaaaatgaaaaaaaataagatgctttcctatggtcccagctacttgggaggctgaggcaggagtgtcgcttcagcccagaaggttgaggatgcagtgagccatgattgtgtttcagcctggatgacagggcaagacctcatatctgtaaaaagtaaaaataaataaacaaactatataataataatacagaagacaaatgtcaatgttgctgaaaagccaaaagaagccaagaggacagtcttctgagtagagggcataggagttcccaaagaggaaagtccagtctgagatcaggctggaggccaaaaggaactcttgacctgagacagttggaaatattacttctactggcaaataaaagtgcttcaagcagacgtttatttagaaattcatgctgcatgtttattgatggaatgtttgtgtgactctttaatagaagtctgaactaggtatgccatatatttccatatatcttcatttgtcttgggggtaagtgttgagagaaggaagtggcttttggttttgtgagtgtcttgaagatctaaggtttattgtgaaaaagtgtaggggtaatttttttttttttttttttttgagacagagtctcactgtgtcacccatgctggagtgcagtggcgtgatctcggctcactgcaacttccgcctctggggttcaggtgattctcctgcctcagcctcctgagtagctgggattacaggcacctgccaccacacctggctaatttttgtatttttagtagagatggggtttcaccattttggccaggatggtctcaaactcctgacctcaggtgatccacccgccttggcctcccaaagtgctaggattacaggcatgagccatcgtacccggccagagcatccttaatttttaaaaacaatttagctactttttttttttttttttaactattttaagagcatcacagtaaaaggaaaataacagctcactttggggccaaagtctaaaatttaaaatcagccctactctggctgggtgcagtggcttatgcctataatcccaacactttgggaggcaggaggatcacttgagctcaggaatttgagaccagtctggacaacaaagcaaaaccccatctctgaaaaaaaaaaaataccccgggatggtggcttagggctgtggtcccagctactctggaggctgaggcaggaggattgcttgagcccaggaggttgaagctgcagtaagccatatttgtaccactgcactccagcctgggtgacagagcaagaccttgactcaaaaaaaaaaaaaaattctactctcttggtatttgtaatatgttatgagataccatcattggaggttgtaaggatgggaatattagttgaaagtctgatattttatcattgagttgcccttttccaattttacatgcttaggttgacttctcaatagcaacagtaaaaatcagaagacagtaaaagaatgtcttcaatgttctgaaagaaaatatctacctagaagggttattcacaaaccagggtgaaataatgtcattttaaacaaaatatttaataccaagaaagttggaaacataaaaaaataaaaagtcatgctcggccaaatctaaacagacttaaaaattataagatgtaatttgatggtacaaaaatatggaaataagccccagaaaataacagtatgtaacattggaagaagtctaataatttttaggggagtagagattctgattatcccacatggcagggcattagacaaggagacccactttaccacagataaggttcagtggtggtcccatgactgatctattggtcacaccttatgcttaccccaccacctagaagcggctggtgtgacagagcattggatgacctgctgaaggtggtttgaagtaccagcttagtggcagtacttgacaagcacagggcaccgtcctccaagatgcagtcctggaatcacagacttttatctggtagtgattcctcaatagggagtgtacacaggtccaagagccaaggagtgggaacgggatcagctccacttaacatcatttccagtgatcagtttggagactgaagagcaacagtctgaggaatgaccccaggcagtaatttgtttccacagaaaaaacaaagagcaccagtaaagggtaattatgtaataataaaagatagtgcaagtgcagatttcttattttattagtaactgattaataattataggccaggcgtggtggctcacgcctgtaatcccagcactttgggaggccgaggtgggcggatcacaaggtctggaggtcaagaccatcctcactaacatggtgaaaccccatctctattaaaaacacaaaaaattagcggggcgtggtggcgggcgcctgtagtcccagctactcgggaggctgaggcaggagaatggcttgaacccaggaggcagaggttgcagtgagccgagatcacgccaccgcacttcagcctgggcaacagagtgagactccgtctcaataacagcaacaaaaaaagcaattatataaaacaatatgcagtactgtttggactataacatacagaagtgtaatatgtctaccaataacaccacaaaggaggaggatgggagaagagtcgtgttggggtaaggaaatggctctagatggcaacttaaagccacaagaataagctgagagaaccagaaataggaaataaataggctactgtaacaaaagctgttaatatatactttctcttcatctctcagcctctttaaattataaaatatataaagcaatatttatagcaatgtgttgttgcatttgtaacatagatatatatatcaataccagcacaaaagtcggggtgggggctagaactatataggaataatgggtttataaaagtcttattggaattaaggtagtataaatctgaagtagactctgataagttaatgtgtatttaacacttcctagaacaaacactaaagaaataactgcaaaaatattgtaaggaatcattaaataaataaaatattacattacaaaatatgcacttaagacaaaagtgaaggagaaatagatgaacaaaagatacatgagacataaaatacaaaagggaaagcagcatatgtaaatctaactatatcaataataacttttttttaagagggtcttgctctattgcccaggctggagtgcagttgcatgatcatagctcactgcagccttgaactcttggcttcaagcaattctcccacctcccacctggctattttattttattttatttatttatttatagagatggaggtatcaaactccagggctcaagcaatcctcccattctggtctctcgaagcatcaagattataggcatgagccagcgcacctggccagtaataacattaaatgtgaatagattaaactatcaaaagacacagattgtcaaagtggtgataaaaaaaaatccaaccatgtacagaagacatacatacatactcaaagatacaattggattagaagtaaaggatggaaaaagatataaaacgcaaacagcaaccataataaatctccagtggctttctaatatcagacacaatagagtttaaaacaaaagttttactagagataaagaaaagtattttgtaaagataagtcatcaagaagatgtaacaattataaatagacaattgggattacatcaagctgggaagcttccatactgccgaggaaataacaaaataaagagacaacccacagattgggagaaaatatttgcaaactatccatttgacaaggggttaattgccagaatatacagggagctcaaacaactctatagcaaaaacaaagaaaaataacaaaaaaaaaaccccaaactccagatattccaattataaagtaggcaaaagatccaaacagacgtttctcagagaagacatgcaaatgtctaacaggtatatgaaaaaatgctcaatatcaccacttatcagagaaatgcaaattaaccacaatcagatatcatccctcttcagttaaaatggcttgtatcagaaagacaggaaagaacagatgctggtgaggatatggaggaaggacagccctcgtacactgttggtgggagtggaaattagtacagccactatggagaacagtatggaggctcctcaaagcaactgaaaatagaactattatacgatccagcaaccccactactgggtgaaaagccaaaagaaaggaaatcagtacatcaaagagacacctgcactctcacgtttcctgcagcactatccacaagagccaaaaaatgaaatcaggccaggcgtggtggctcacgcctgtaatcccagcactttgggaggctgaggtgggtggatcacttgaggtcaagagttcaagaccagcttcaccagcctggtgaaaccccgtctctactaaaaatacaaaagttagcggggtgtggtggcagacacctgtagtcccagctactcgggaggctgaggcaggagaatcacttgaacccgggaggcggaggttgcagtgagttgagattgaactgctgccctccagcctgggcgacagagtaaagctccatctcaaaaaacaaaacaaaaaaaaaatcagagcccatcaacaaatggataaagaaagtgtgatatatataaacacagtcaatatgtctattcagtcataaaaataaaatcctgtcatttgcagcaactgggatggaactgaaagccattataataagtgaaataagccaagcacagaaagacaaatattgcatgttctcactcatatttgaaagctaaaaaagtagacctcatgaagatagagttgatggtggttaccagaagctgggaagagggggaaggatgaaggggaaaaatatgaatgtatctattattgctgaactgtacacttaaaaatggtaatgatgataatatttataatatatttacattttgtttatatatttatattttgcctcaaaaaaggcaaaaaagaagatataataattataaacatgtatgtacctaataacagcaccaaaatacatgaagcaaaatctgacagaaatgaagagagacaactcaacaatactagttggagacttaatatcccactttcaatattagaacaatcgtataagttgtctaggactgtcgtaacaaagaaccacaaactggatggcttaaacaacacagatatattgtcttactgttctggagcctccatgtttgaaatcaaggcattgacaggttttggttccttctgagggctctgagggaaggatctgttccaggcctctctccttggcttgtagatggctgtcttctcactgtctcatcacataatctcccttctatatgcacatatctctgtgcaaacgtcccctttttatagggacatcagtcatattgactcctaagtcctcattttaacattgttaactctgtacagaccctctctccaaataaggcctcactctgaggtatggaaattaggaccccaacatatctctttgagttggggggacactactcaacactgaagtgtttagggatgtcgagaaattatgcctccaacctatgctcatacattttttttttctttttcattttttttttttttttttgagacggaatctcactctgtcaccaaggttgaagtgcagtggcaccgtgtcggctcactgcaacctctgcctcccgggttcaagtgattctccagcctcagcctcctgggttcaagtgattctccagcctcagcctcctgagtagctgggattacaggtgcccaccaccacgcccagctagtttttatatttttagtagagacaggttttcaccatgttggccaggctggtcttgaactcctgacctcaggtgatccacccacctcggcctcccaaagtgctgggattacaggcgtgagccactgtgccctgccaatgcttatacatttcaagaaaaacatttatttggccgggcatggtggctcacatctgtaatcctagcattttgggaggccgaggcgggtggatcacctgaggttgggcgtttgagaacaacctggccaacatggtgaaacccccgtctctactaaaaatacaaaaattacccaggcgtggtggcaggcacctgtaatcccagctacttgggaggctgaggcaggagaattgcttgaacccgggaggcagaggttgcagtgagccgggatcacaccactgcactccagcctgggtgacagagtgaaactgtctcagaaaaaagaaagaaagaaaaacgtttatttgtagagaaagctaacatggtaaaaatttgaggaatattggtaaagaatatttacaaattcattatcattgtgtaaattctatattactttttaaactttcatgttttgtggagtcatttctaaatcaaatcattaaaaagaggccaggtgtggtgactcacgcctgtaatcccagcactttggaaggccaaggtgggcggatcacttgaggtcaggagtttgagaccagtctagccaacatggtgatagcccctgtttaccaaaaatacaaaaattagccagggtggtgacgtgcacctgtaattccagctactcgggaggctgagacgggagtatcacttgaactcgaaaggtggaggttgcagtgagccgggatcacatcactgcactccagcctgggtgacagagtgagaccctgtcacacacaaaaaattaaagtcattaaaaagaaaaactgaattttgcaaaattattggatgtcagtatattcaaatcaattttatttctatatatcagaaaaataatataaaatgggatttaacaaattgaatcaattttcagtggcatcaaaatacaaaatagatacaaatcttatggtgttggaactgttcagcatcttgaaggtggttgttgatacatgaacctacactggtgataacattgaacagaacttaatatacacacatacaaagtataagtaaaactggggaaatgttaagtattgtgtgtcagtattctggctgtgatatactgtagtgttgcaaaatgttagcattgggggaaactgggaaaagtgtataagggatctctgcattattttgtatactctaggtgaaactatctcaatacaaatttaattaaaacaaaataaatctgataaagatgtaaaagaataaagagactattatccagttgataaaatatgcaactatgaaataaactgaataaattgaacaagcttgaacaaattgaatcatcaatatgttcaagtcctagacatttaatagtgataaatgttattccccaaatactgtatgtagtataacatctttgttaaaggccaagataaagcaaaatggagttatatattgtttaggcatatgtgtttatgtgacaaaacaacggggaaaaaaagctagaaaatgataatcaaaatctttaggatagtgtctacaccctgtggaagaagcagtgagttggaaaaagggaacactaagtagaggcttcaagttatttttaattttctgtttgggtgaaagattcaagagcattcgtgagaatgtacttgtaactagtatttgatgaacaggggctatacaacagtttagattttaaaaaattatgggagaatactaaggataaccatacgccagtcaaataaaaatagataacacatttttcagttttctagaatactgcacattatcaaaactgaccaaagcagaaaaagcaagactgaataaaatcaacaataaataacaaaattgaattggagtatcaaaagcttccctcagtgaaatatagcaaagcccagatggatgtccaataaaattttagcaaacattaaggacttgattatcattatgtaagcagtattagagaatttttaaaatatagattacttccaaattcacctagaaattcttttataacctttacaccaaatcaggatagagacagtagaagaaaaaataaatacaggtcaatctaatatatgaaaattttctgagtaaatgaaatccaggtctctttcgccatacatttgtatatgaggttgaaccataggaaattacaataatcaaccatgttttacatatgtggcagattttattttctgaagtgggctatgacagtagcttccatctcatctcctcttctacagtgtgatcttgccactcctcccacttatagtcttgccccatcctttgagttttgttggcttgtgagtcacttgtagccaaaagaatgtggaggaagtgatcatgtaacttcgcaggatataaaaagccatgcggcttctgccttgattgcagagatccttcatttgccatgtaagcagtccttgaagctgcagtactaggaggaaatctcaaataatccatatagagaaaccacatagagaggctctgagattacataaagagatgcttgttcagccccatatgctcccgttccatgcctttctggctccatgagaaattctgacccagaacggctcagtcagacctctcctgaatccctgacaaacaggaaccatcagaaataataacgtctttgttgctatttgtgctataatgttttgaggtgatacgttagactacagtagtgattggaatagaaatttagtgttggaagtggggttctacttacatgcatcactggccttggcactggatgatgagcagaatctgaaaggcccttgagtaaaatatcagtaaaacccagtgggctttggggatggtattagcagagtctaaaagtcatcaaggaggttgctggtgagagcttgaaggaacacaaggaaagcattattgaaacatggagaaaatgagacttttttatgtagtgacaggtgtatcaacactgtcacctaatgtaaatggaaaatagaagatgtacctcatgacctcagtgatagagctaagtgttttctagacccagtgttcaggatgctacctggctcctcattgcttataataaaatgagaggaaagagaactaaaaaatgaaccattccatggaggaaatggtaaacagtcttttcagcttgtaaagcattctcaaagtacgaaagctcctcagggaaaagatgtaatccaaggctggctataatacccttatgtaagattccagaaagatctgaagcggtgcctcctgacccccttcaatgaataaacaaaaaggacttctaaggacttgagagaatgcttctgtgagccctctctcataagcaacagaactgctaagaattttaagggtgaggtcccacaaaaggcccactgagagcccatagtagagaaagtcttattaagagatttttggggtgtggcttttgtctaatggaatgggttgtacacagatagctaaaaatcccacacgttcttaaaaacagtgatgctaactttacagataaggacaaactgtataaaaaaagatatttgaactctcaacctttttgctcaggaaggaggttgagaaggatactcacttgcaaacatggtcacattttatgaaaaaccatggatgactcagagagcagaactaagatccagagggtagagcaaagagccatggaggagaagtccaagaaagcagaaccaaaccctaatcaccgaactggtaatgggtacccagtaggatttatggatttctatggaacagtgactactctgtgcctcctcttgtccccatttttgaataggagtattggtaacagtttttctgtgtctgccccactgttacgttctgggtgtgtaagatgaaaataacttgtctcatatttcacaggcattcagattgggagaaatagcacctcaggaactgcatcctcaagagtcccatctgcacctgtagcagagtttgacgatgagatcctggtcttcaatctgatattataacgggatgagacattgggatcttgggggaggagatggctgtactttgcatgggggggatgtgaattgttacagccagagggcagaccgtggtaatcccaaacatggccaaaacagtatctcctatcacacattctcttccacagtgtgcctgctatatatttctcccatgagagttgaggtcgacaccagctccttgaacctgggtggacttgtaatttgcctgtagccaacagaatgcagcagaaataggccaggtgcagtggctcatacctgtaatcccagagcttcaggaggccaaggcaggaaaattgcttgagcccaggagtttgagaccagcctgggaaacacagtgagaccccgtttctatttaagaaagaaaaaaaagaatgcagcagagatgaagctgtgtaacttccaaagctaggtcataaaaggtgatgcagcttccatcttgtcactggaattcacactcttgaaccattcagcagccatataagcagtccaatggccctgagctgccctgcagtaagaaagcccaaactagctcacacacagactacatcaagagtgagagatgcctaaaacacccccaggcattccagccccttctgttctagatctagccttagaaaaagctgcctagctgagcctatcttgaatttctgacccaggaaactattagatataataagtcacttttttttttttttgagatgcactctcactctttcccaggctggagtgcagtggcacgatcctggctcactgcagcctcctcctactgggttcaagcagttctctgcctcagcctcccaagtagctgggattacaggtgctcgccaccatacttggctaatttttgtatttttagtagagatggggtttcaccatcttgggcaggctggtcttgaactcctgacctcatgatccacctgcctcggcctcccaaagtgctgggattacaggcgtaagccactgcgcctggccaataagtctctttttttaggtaatcaagttaaaataataagtcactaaattttgaggtgttctgttatgtagaagagtgactggaccaacccataaaaaggacaacttcatatagttcaactttttttttttttttttttttttttgatacagagtctcgttctgtcacccaggctggagtgcagtggcataatttcagctcatggcaacctccgcctccaaggttcaagtgattatcatgcctcagcctcccaagtagctgagattacgggcacctgccaccacgcctggataatgtttgtatttttagtagaggtggggtttcaccatgttgactaggctggtctcgaactcctgacctcaggtgatctgcccgccttggcctcccaaagtgctgggattacaggcatgagccattgcatctggcctagttcaactttataaataaatatgtcaaagataattcaatattaaagtttatatatttatcattttaaccaaataatgtagaaatagagtgatatgaaacataaatacctatataggttaagaaaaatattcaataaattggaacaattctttgttataaaattcttaagaaactcagaataaaatgcaacacctttttacgattataaacccctcagcaaacatacttcaagcagaaccttacgaacagtataattaaaatgaggaaccgctgag

SEQ ID NO: 201923 - DNA, 4853 bp, Homo sapiens
  Payload ID: 19835
  Gene Name: zinc finger protein 26
  ENST ID: ENST00000534834
  CDS Start-End: 2666-4207
tatgttctgctgatttcagtgctcaccgttgtatccagcttcccaccaattctttctgtgtcttaatgttgtctctatagggtgtaattttttttttttagagacagagtctggttctgttgcccagtgtaaagtgcagtggcatagtcatggccaactacagcctcaaactcctgtgctcaaaccatccttccacctcagcctcctgagtaactgggactacaggcgtgcaccactatgcccacacatttttttgttatttgtagagatgaggtctaactatgtgacccaggatagtctgaaactcttggcctcaagtgatcctcccgcctcagcctcccaaatgctgggattataggcatgaggtaccacatttgatggatataaattttccaggtgctagtatatttgaaaatgtcttttattttcccttatttttgctttttagtttggctggtataagatttcagaatcagcattattttttctcagtactttatttctctcccactttcaagaagcattgttctttccttttagttggttatcaggtgttctctttatactttattttcagacatttcattaccatctgcttaaatttggaccttttttttgtttgttaacttatcttgtatttcaattggtaggtttttctcatgtgaactcctgtatttgtcttcactccaagagaattttcaggccgcatttctttgaacattgccctattatttctcttatttatataaacctacattggtaattcttctataaaccaggaaaatcattccaggtttatttatttatttatttttttgagacggagtcttgctctgtcgctcaggctggagtgcagtgatgcgatcttggctcactgcaacttctgcctctctggttccagcgattctcctgcctcagccttctgagtagctaggattgcaggtgcccacccccacgcctggctaatttttgtatttttagtagagacggggtttcaccgtgttggtcaggctggtcttgaactcctgaccttgtgatccgcttccctcggcctcccagagtgctgggattacaggcatgagccaccacacccggccaggtttattttgtagtctagctcttacctgttcacctgttgtagccatcgctgtggtttgagtgtatcttccaaatttcatgtgttggaaatttaattcctaaatttatttgttgatggtatttggaggtgggacctttgggaggtatttaggatttgataaagtcatcagggcagggcccctatgatgggattagtagccttaaaaggataggaagagagacctgagctggcatgctgtctgtctctcatcatgtattgccttccaccaagttatgacatagcaagaaggccctcaccagatgccagcaccatgcttatggacttcctggcctccagaaccttgagctaaatgaacatttttctttataaattacccagtttctggtattctgttataaaaatagaaaacaaagacagcagtcttttcggtgtctgaaatatttgttgttccttgaattgaccaggctctaccatgtgttctgtgtgatgcttgcttctggtacagggactgcaaattatgttccatctatttttttttctttctttcataatagatttgccagtttttcagttgggcatatacagaaactccatttctgaatttccctgctgttccctcccagcccccactctttgctgttgcttagaatgcagatgtgatgactagagccatcttagactgggttgccctggaagtggaagccatgtaaggtggagcaagagatggaagccccagaccaattgccttcagactcctgcaagtagaaggataaactctcttgtttatccccctgttctcagctgaacctcgtccaaacacctcctgaattgccctttctaccccaacttcttgaacacatcatgaatcttctaagactacttgagtggctctcttcatttctgtacaaaatgtaccctggatgtttttaccaaggactcagaacaccttattttgtttgcatgtataaatgttcattcccatctacaagatagaaagtttcttgaagacagaactggattttattcatcctgaaatcttcaggacccaagagagtaccggcaaatagaagctccttgattgattttttctttctttcttttttttttttttagatggagtctcactctgtcgccgaggctggagtgcagtggcacgattttggcttgctgcaacctctgctgcctgggttcaagtgattctcctgcctcagccacctgagtagctaggattacaagtgcctgccactgcgcccagctaatttttgtatttttagtagagacagggtttcaccatcttggtcaggctggtcttgaactcctgcccttgtgatccacccgccttggcctccgaaagtgctggcgtgagccaccgtgcctggcactccttgattgatttttaattctctcacaaagtaaatgctgaaccagccacaggaaatagttggtagaggaacatttatcccttcccagttcctctgcatcttttccatgtcacctaatgtaattgcatccaattgaacagggtgtgtgttatttcagggattattgtcattcaaggatatatctatggagttcacctgggatgaatggcagctactggattctacacagaagtacctgtacagagatgtgatattggaaaactatcataacctgatatcagtggggtatcatggtaccaagcctgacttaatcttcaagttggaacaaggagaagatccatggataataaatgccaaaatttccaggcagagctgtccagatggctgggaagaatggtaccagaacaatcaagatgagcttgagagtattgaaagaagctatgcttgtagtgtgttgggaagacttaatctgagcaaaacccatgattcttcaagacagagactctataacacacgtggaaaaagtttgacacaaaactcagctccaagcagaagttatttaagaaagaatcctgataagtttcatggttatgaagaaccatattttcttaagcatcaaagagctcatagcatagaaaaaaactgtgtgtgtagtgaatgtgggaaagcttttcgttgtaagtcacagctcattgtacatctcagaattcatacaggagagagaccttatgaatgcagtaaatgtgaaagagccttcagtgccaagtcaaaccttaatgctcatcagagagttcatacaggagaaaaaccctactcatgtagtgagtgcgagaaggtcttctctttcaggtcacagctcattgtccatcaggaaattcacacaggagggaaaccctatggctgcagtgaatgtgggaaagcctacagttggaaatcacagcttcttttacaccagagaagtcacacaggagtgaaaccgtatgaatgcagcgaatgtgggaaagcctttagtttgaagtctccattcgttgtacaccagagaactcatacaggagtgaaaccccataaatgcagtgaatgtgggaaagcctttaggagtaagtcctatctccttgttcacatccgaatgcatacaggagaaaaaccctatcaatgcagtgattgtgggaaagccttcaatatgaagacacaactcattgtacatcagggagttcacacaggaaataatccttatcaatgcggtgaatgtgggaaagcctttggtaggaaggaacagctcactgcacatctgagagctcatgcaggagagaagccctatggatgcagtgaatgtgggaaggctttcagcagcaagtcataccttgttatacataggagaacacacaccggagagagaccctatgaatgtagtttgtgtgagagagccttttgtggaaaatcacagctgattatacatcagagaactcattcaactgagaagccctatgaatgcaatgaatgtgaaaaagcctaccctaggaaggcatcacttcagatacaccagaaaactcattcgggagagaaaccttttaaatgcagtgaatgtggaaaagccttcactcagaagtcatctctcagtgaacatcagagagttcacaccggagagaaaccatggaaatgctctgaatgtgggaaatccttctgttggaattcagggcttcgtatacatcggaagactcataaatgagaaatcagaatgatgcaatgtgagaaactgatgttcaggagacttcggataatatagacaggatttacaagcaggaggccctaaaattacactcatgtcaaaaatcagagaggagagagaccaaccatatttgggatgagtgtaaaagctttcagaaataagttacaaatctttgtagatgaaaataatggaaggaatgtggagcaataaatgtatcaaatgttgtagtatcatcatgaagattcagagaatttacactaggaacaccttataagttgaataaattaaggaagcattttcccattgaaagtgtgttccatggaaagtcacattccagatttgaagctgtgtttttgtaaaataaaatcttggtatgaacagttgacttcatggtggagtataaagttgtttttttaaaaatatgtaaataatgttcaggaaaaacgcagggaacagagtcttaaagttaatggatatttaatgtgactttcctgagttaacactgaatagtatttctaaaattttttgtactttattttttaatgtaacttgttctatctatctatatatatatttgatagtttgtggaataatatcccccagtattttccatattaaatgctaattatcttttgatttctttttc

SEQ ID NO: 201924 - DNA, 639 bp, Homo sapiens
  Payload ID: 19835
  Gene Name: zinc finger protein 26
  ENST ID: ENST00000540238
  CDS Start-End: 399-639
ggtgtacctggctgagtctctgtggccgcggaggcgcggagctaagcggctcggattatcctgggcagaccagagacttgaccagctaaacacttccgtcggtccggggcgtggacggggccagatcagcctcctgctctcccgagtcagggccacggaaaggcacaaatccatccgtgcgactcctggtacccagaccgggaggttgtctagtcacgcgcggtctgtgttgggcgagagctgaggagccggcgtccctgccaacgactcggccccgggacggtcaggagcctggggccctggtcccgcacctgtcttcgggcggacgcatccctcacggtctctccgcagcccgcgggtcctgcccccgcaggcagcgcgcgaacgtgggcgtggggatggccaccagtttccggacagcttcgtgctggggattattgtcattcaaggatatatctatggagttcacctgggatgaatggcagctactggattctacacagaagtacctgtacagagatgtgatattggaaaactatcataacctgatatcagtggatggctgggaagaatggtaccagaacaatcaagatgagcttgagagtattgaaagaagctatgcttgtagtgtgttgggaa

SEQ ID NO: 201925 - DNA, 834 bp, Homo sapiens
  Payload ID: 19835
  Gene Name: zinc finger protein 26
  ENST ID: ENST00000544181
  CDS Start-End: 374-834
ccgcggaggcgcggagctaagcggctcggattatcctgggcagaccagagacttgaccagctaaacacttccgtcggtccggggcgtggacggggccagatcagcctcctgctctcccgagtcagggccacggaaaggcacaaatccatccgtgcgactcctggtacccagaccgggaggttgtctagtcacgcgcggtctgtgttgggcgagagctgaggagccggcgtccctgccaacgactcggccccgggacggtcaggagcctggggccctggtcccgcacctgtcttcgggcggacgcatccctcacggtctctccgcagcccgcgggtcctgcccccgcaggcagcgcgcgaacgtgggcgtggggatggccaccagtttccggacagcttcgtgctgggtagtgctgctgaggaggagcctgctaatgagctcaagtgtcaagttcgggaatcttctgggtgttccttgggcccagggaaacagtgccctgcctgagggattattgtcattcaaggatatatctatggagttcacctgggatgaatggcagctactggattctacacagaagtacctgtacagagatgtgatattggaaaactatcataacctgatatcagtggggtatcatggtaccaagcctgacttaatcttcaagttggaacaaggagaagatccatggataataaatgccaaaatttccaggcagagctgtccagatggctgggaagaatggtaccagaacaatcaagatgagcttgagagtattgaaagaagctatgcttgtagtgtgttgggaagacttaatctgagcaaaacccatga

SEQ ID NO: 201926 - DNA, 5666 bp, Homo sapiens
  Payload ID: 19836
  Gene Name: zinc finger protein 260
  Uniprot ID: Q3ZCT1
  ENST ID: ENST00000523638
  CDS Start-End: 1123-2361
ccggcttgagcccagccaaagggattaccctcattcccgaaccgtgtctgagagtctcctggggttcctggcttagtatcgcaccgtggctgttacataaagtcagcacagcgtgtttaagctgatgttacaccactacccaatcccagggatagagtaaactaagactaaggccttacacccctgccccggccagggagacagtcccacaagctctggcggaggaaaagttcgcgcgaaaagctgactcaaaccgctgaaccttctgggaaatgtagtctaccctcaaaagagtggcacggaggacgggccaagatctctcgattccgtccggttctgagtcggggcctggcccagcccaggagacctctgggagcgctgcccgcggaaggagtgcgcaggcgcggaatctccgacttgccatggtcgtctttgtctgccggcctgcttccttgtatatccacaggagctgcaaaacctcttagagttctaagggcgctccctgaattttgggatgctgctttgttccccaaccataacatccaagtccagtgtcatttttctgctcacaagtttaaagtcagcacttaaaagaacagcaacagatgattgagaaagaaatgtaaagaaggttctctttgtgtgagtaagcaagaacctgaagaagcctgggaagtttataaacagataaagacgcaacatgaaagacttgtaagttaagtctcatctttctctgtgaaaagacagactgagggaaaatttaggaaacaaagtatttcctctgaacagtcattgattcttcaagactacccttctgtgtatggaactcagtttaaaagaatttgaaacctaatttatatacaatctatacctaaatatgggagaagctatataagaaccattaagaatataaagagaatgttacattttatccctttttgtaatcatctcatctcagggtaatcaatgtgagaaaagtcttccatcataaatttaacttcattagatacctgagaattaatattgaaaatacaccatatgaatttagtgaatgtgggaaagctttcatccttattacatcttatttgatactagggaaatctcctgattaaattcacatgcatgataggcatgttggaaagtcttcagcatgaatcagatctccttcagcatgatcaaattcatactggagagaaaccttatgaatgtaatgaatgtagaaaaacttttagcctgaagcaaaaccttgtagagcataagaaaatgcatactggagagaaatctcatgaatgcactgaatgtggtaaagtgtgctctcgagtctcatctcttactctacaccttagaagtcacacaggaaagaaggcatataaatgtaataaatgtggaaaagccttcagccagaaggaaaacttcctttctcatcagaaacatcacactggagagaaaccttatgaatgtgaaaaagtttctattcagatgccaaccatcatcagacaccagaaaaatcatacaggaaccaaaccctatgcatgtaaggaatgtggcaaagcctttaacggcaaagcatatctcactgagcatgagaaaattcatactggagaaaaaccatttgaatgtaatcagtgtggaagagccttcagccagaagcaatacctcattaaacatcagaacatccatactggaaagaagccctttaaatgtagtgagtgtggaaaagcttttagccagaaggaaaacctcattatacatcagagaatccatactggagagaaaccttatgaatgtaaagggtgtgggaaagctttcattcagaagtcaagcctcattagacaccagagaagtcacacaggagagaaaccttatacgtgtaaggaatgtgggaaagccttcagtggcaagtcaaatctcacagagcatgagaaaattcatattggagagaaaccctacaaatgtaatgaatgtggaacaatcttcaggcagaagcaatacctcattaaacatcacaatattcatacaggagagaaaccctatgaatgtaataaatgtggaaaagccttctctcgaatcacatcacttattgtacatgtgagaattcatacaggtgataagccttatgagtgtaaggtctgtgggaaagccttctgtcaaagctcatctcttactgtgcatatgagaagccatacaggtgagaaaccctatggttgtaatgaatgtgggaaagccttttctcagttctcaacccttgctctgcacatgagaatccatactggtgaaaaaccttatcagtgtagtgaatgtgggaaagctttcagccaaaagtcacatcacattagacaccagagaattcatactcattaaagttctctatgaatgccttggatttagcaaaacgttcagcagattttacacttaatagtgtattggaaaattcattttacattaaagtgacatgaatgtgggaagtccttcagcagcaattcaaaacttaaatactatgatgtttaataagtattatagtgtaaagaaaacccgtacccccaaaactcccacaacaagcattatcaatgctgtacttctaggagtatactcattaaagttaggatctagtcatggacactacttaatgtgttcctggaaggcctacagatgcattaagaaatagatatgagatgtatgaggatttgaaattaagagacaaaattatcatttttgtgatgttttgctacatatatgaattgtaaaactagaatcatcaaaattatttgttgttgaagcagtcataaaactgagactgagacagaatattgaattcagaaatgtgtgcatgaatatatggggaattggtaattgatagaggcggtatcccagattggtggggaaatcatggattacttaaaaattaattgactcttcatatggaaaaataatatctcccatcataatataaaatatttttcttatgaattcttaaagtactaaagactaaaatgcaaaaagcaatacttaataatataacagttttataagaagatgtttttaaaaccttagggcaggaaagaacttctaaaacattccagaatacccggtagttccactcttgagtatggtagtcccctattttctgcaagagatggactctaagacccccagtggatacctaaaacccagataggaccaaactctatgtctatgtttttttcttatatatacatacctatgataaaatttagtttacagattagacacagcaagagatttaaaacaataataaacataatatggaacaattataacaatatactgtaatcataaaagttatgtgaatatgatctttctctcagaataccttattgtactgttctcaactatttatgaactgtggtgactacaggtaactgaaaccatggaaagcaaagctgtggataagggggaactactatatatatgcatctacccaagaaacatgaacacagggagtcatgtactggtctatagctgtatagttcattgcaccatgagttatagtagccagaagttgggaaacaaatgctgtctcttgtgaaatagatgaataaaatgtgatagtaacatagtagagtactctctagcagttaagtgacaaattaagtctatatattaacagaaatatttttaaaaaattagagtgaagaaaaatgatgaacatattgtaatgatgcttctgtgaatttgaataaaatcaacactaaccagccctagtactaagaattggttatggataaattatgtaaaactaaagaatggattgaaaggatatgtatatactcagttcccaaaagtggagtggttacctctaggaagaaaggaggtggaagggaaatgttaccaagcatggtagttaaaggatacttcaattttgtatctatttcttattaaaaagaaacattctaagtaaacataacgaaatattaattctgggtggtggtaatatttgtgttcattctatcattcgtgctatttatttccttaaacttctgaaagttaaaaagtccagataggagtgaggaagctgtacatgaaacataatggacttacattcctagtcagatactaatattctgtagaagatatttctaaaatcttatctttaaaatatgaaataatttttaattggggtggcaacttaaattcaattaaaataactcatgtgtcacaagagtaaattttacataatctgtacgtagttctaatctgtatatagtcttggaggttatgatttgccacagattggttggatcacatacatttaaggatcatattattaaataatatatgcacagacatggagagaattagtttttactaaaacatttatcagaaattttaatactctgcataaccagtattagcattagaaattagccacttttaaaatgagaaaactgtgtcactcttcaatttttttataagccattgaggaaaacattaactcctggatttcagcttcacttttaacctgcagactaaatttctttctcaattatgtcagacacacccaagtcaatcccaacccccttgttaccttgggaagaccgtgctgaaaaaggagatcttccacctaaacagtgttctcttatttgaagcaaatctttttgagaatttgtttacttgatttctttccacaataaactgacagagaacgctactaatgatttttttttttttttgagacggagttttgttcttgttgcccaggctgcagtgcaatggcacaatcttggctcactgcaacctctgcctcacaggttcaagtggttctcctgcctcagcctcttgagtagctgggattacaggcatgcgccaccatgcccggctaattttgtatttttagtagagacggagttgcaccatgttggccaggctggtcttgaattcctgacctcaggtgatccacctgcttcggcctcccaaagtgctaggattacaggtgtgagccaccacgcctggctaattttgtatttttagtagagatggggtttctccaaaggctggtcttgaactcccgacctcaggtgatccgcccaccttggcctcccgaagtgctgggattacaggcgtgagccaccgtgcccggcctgatgtttttgaatgattatgaaaatgggtatacagcattaaaaccttagactgattttaaatatattaatttcttttaaactcaatataatgttaatattactgtagcacttactagcatttctgaaggttggtcttgagataagattgaaaatgacagttgttgattttctgaggtaatatacccaaataaaatatatgtatgtgtacatgaatctaaactgtcttcttctgttcctcattttgctttacttaaataatctttcatattttttaagtgttttgcccatgtgcttgggtagccttgaagtcaccagaataactaggactcaaattcagaccaaaccaggactagctttttgtgccatgagttagccatggtcctggacccagcaaaaagaatgattatgatggtcagagtaagatgagcaattgcaacataatattctctaatattgtatactgtaaatttattcagctgccctcgtttactcacagtttgcttatttgccaccataagaaatggtacaataaaaattcatgtaatc

SEQ ID NO: 201927 - DNA, 5055 bp, Homo sapiens
  Payload ID: 19836
  Gene Name: zinc finger protein 260
  Uniprot ID: Q3ZCT1
  ENST ID: ENST00000592282
  CDS Start-End: 845-2083
agtgcgcaggcgcggaatctccgacttgccatggtcgtctttgtctgccggcctgcttccttgtatatccacaggagctgcaaaacctcttagagttctaagggcgctccctgaattttgggatgctgctttgttccccaaccataacatccaagtccagtgtcatttttctgctcacaagtttaaagtcagcacttaaaagaacagcaacagatgattgagaaagaaatgtaaagaaggttctctttgtgtgagtaagcaagaacctgaaaataattcttccgggccgggtgcggtggctcatggctgtattcccagcactttgggaggccaaggcgggtggatcatgaggtcaggagttcaagaccagcctggccaacatgaagaagcctgggaagtttataaacagataaagacgcaacatgaaagacttgtaagttaagtctcatctttctctgtgaaaagacagactgagggaaaatttaggaaacaaagtatttcctctgaacagtcattgattcttcaagactacccttctgtgtatggaactcagtttaaaagaatttgaaacctaatttatatacaatctatacctaaatatgggagaagctatataagaaccattaagaatataaagagaatgttacattttatccctttttgtaatcatctcatctcagggtaatcaatgtgagaaaagtcttccatcataaatttaacttcattagatacctgagaattaatattgaaaatacaccatatgaatttagtgaatgtgggaaagctttcatccttattacatcttatttgatactagggaaatctcctgattaaattcacatgcatgataggcatgttggaaagtcttcagcatgaatcagatctccttcagcatgatcaaattcatactggagagaaaccttatgaatgtaatgaatgtagaaaaacttttagcctgaagcaaaaccttgtagagcataagaaaatgcatactggagagaaatctcatgaatgcactgaatgtggtaaagtgtgctctcgagtctcatctcttactctacaccttagaagtcacacaggaaagaaggcatataaatgtaataaatgtggaaaagccttcagccagaaggaaaacttcctttctcatcagaaacatcacactggagagaaaccttatgaatgtgaaaaagtttctattcagatgccaaccatcatcagacaccagaaaaatcatacaggaaccaaaccctatgcatgtaaggaatgtggcaaagcctttaacggcaaagcatatctcactgagcatgagaaaattcatactggagaaaaaccatttgaatgtaatcagtgtggaagagccttcagccagaagcaatacctcattaaacatcagaacatccatactggaaagaagccctttaaatgtagtgagtgtggaaaagcttttagccagaaggaaaacctcattatacatcagagaatccatactggagagaaaccttatgaatgtaaagggtgtgggaaagctttcattcagaagtcaagcctcattagacaccagagaagtcacacaggagagaaaccttatacgtgtaaggaatgtgggaaagccttcagtggcaagtcaaatctcacagagcatgagaaaattcatattggagagaaaccctacaaatgtaatgaatgtggaacaatcttcaggcagaagcaatacctcattaaacatcacaatattcatacaggagagaaaccctatgaatgtaataaatgtggaaaagccttctctcgaatcacatcacttattgtacatgtgagaattcatacaggtgataagccttatgagtgtaaggtctgtgggaaagccttctgtcaaagctcatctcttactgtgcatatgagaagccatacaggtgagaaaccctatggttgtaatgaatgtgggaaagccttttctcagttctcaacccttgctctgcacatgagaatccatactggtgaaaaaccttatcagtgtagtgaatgtgggaaagctttcagccaaaagtcacatcacattagacaccagagaattcatactcattaaagttctctatgaatgccttggatttagcaaaacgttcagcagattttacacttaatagtgtattggaaaattcattttacattaaagtgacatgaatgtgggaagtccttcagcagcaattcaaaacttaaatactatgatgtttaataagtattatagtgtaaagaaaacccgtacccccaaaactcccacaacaagcattatcaatgctgtacttctaggagtatactcattaaagttaggatctagtcatggacactacttaatgtgttcctggaaggcctacagatgcattaagaaatagatatgagatgtatgaggatttgaaattaagagacaaaattatcatttttgtgatgttttgctacatatatgaattgtaaaactagaatcatcaaaattatttgttgttgaagcagtcataaaactgagactgagacagaatattgaattcagaaatgtgtgcatgaatatatggggaattggtaattgatagaggcggtatcccagattggtggggaaatcatggattacttaaaaattaattgactcttcatatggaaaaataatatctcccatcataatataaaatatttttcttatgaattcttaaagtactaaagactaaaatgcaaaaagcaatacttaataatataacagttttataagaagatgtttttaaaaccttagggcaggaaagaacttctaaaacattccagaatacccggtagttccactcttgagtatggtagtcccctattttctgcaagagatggactctaagacccccagtggatacctaaaacccagataggaccaaactctatgtctatgtttttttcttatatatacatacctatgataaaatttagtttacagattagacacagcaagagatttaaaacaataataaacataatatggaacaattataacaatatactgtaatcataaaagttatgtgaatatgatctttctctcagaataccttattgtactgttctcaactatttatgaactgtggtgactacaggtaactgaaaccatggaaagcaaagctgtggataagggggaactactatatatatgcatctacccaagaaacatgaacacagggagtcatgtactggtctatagctgtatagttcattgcaccatgagttatagtagccagaagttgggaaacaaatgctgtctcttgtgaaatagatgaataaaatgtgatagtaacatagtagagtactctctagcagttaagtgacaaattaagtctatatattaacagaaatatttttaaaaaattagagtgaagaaaaatgatgaacatattgtaatgatgcttctgtgaatttgaataaaatcaacactaaccagccctagtactaagaattggttatggataaattatgtaaaactaaagaatggattgaaaggatatgtatatactcagttcccaaaagtggagtggttacctctaggaagaaaggaggtggaagggaaatgttaccaagcatggtagttaaaggatacttcaattttgtatctatttcttattaaaaagaaacattctaagtaaacataacgaaatattaattctgggtggtggtaatatttgtgttcattctatcattcgtgctatttatttccttaaacttctgaaagttaaaaagtccagataggagtgaggaagctgtacatgaaacataatggacttacattcctagtcagatactaatattctgtagaagatatttctaaaatcttatctttaaaatatgaaataatttttaattggggtggcaacttaaattcaattaaaataactcatgtgtcacaagagtaaattttacataatctgtacgtagttctaatctgtatatagtcttggaggttatgatttgccacagattggttggatcacatacatttaaggatcatattattaaataatatatgcacagacatggagagaattagtttttactaaaacatttatcagaaattttaatactctgcataaccagtattagcattagaaattagccacttttaaaatgagaaaactgtgtcactcttcaatttttttataagccattgaggaaaacattaactcctggatttcagcttcacttttaacctgcagactaaatttctttctcaattatgtcagacacacccaagtcaatcccaacccccttgttaccttgggaagaccgtgctgaaaaaggagatcttccacctaaacagtgttctcttatttgaagcaaatctttttgagaatttgtttacttgatttctttccacaataaactgacagagaacgctactaatgatttttttttttttttgagacggagttttgttcttgttgcccaggctgcagtgcaatggcacaatcttggctcactgcaacctctgcctcacaggttcaagtggttctcctgcctcagcctcttgagtagctgggattacaggcatgcgccaccatgcccggctaattttgtatttttagtagagacggagttgcaccatgttggccaggctggtcttgaattcctgacctcaggtgatccacctgcttcggcctcccaaagtgctaggattacaggtgtgagccaccacgcctggctaattttgtatttttagtagagatggggtttctccaaaggctggtcttgaactcccgacctcaggtgatccgcccaccttggcctcccgaagtgctgggattacaggcgtgagccaccgtgcccggcctgatgtttttgaatgattatgaaaatgggtatacagcattaaaaccttagactgattttaaatatattaatttcttttaaactcaatataatgttaatattactgtagcacttactagcatttctgaaggttggtcttgagataagattgaaaatgacagttgttgattttctgaggtaatatacccaaataaaatatatgtatgtgtacatgaa

SEQ ID NO: 201928 - DNA, 4047 bp, Homo sapiens
  Payload ID: 19836
  Gene Name: zinc finger protein 260
  Uniprot ID: Q3ZCT1
  ENST ID: ENST00000593142
  CDS Start-End: 588-1826
gctgctttgttccccaaccataacatccaagtccagtgtcatttttctgctcacaagtttaaagtcagcacttaaaagaacagcaacagatgattgagaaagaaatgtaaagaaggttctctttgtaagaagcctgggaagtttataaacagataaagacgcaacatgaaagacttgtaagttaagtctcatctttctctgtgaaaagacagactgagggaaaatttaggaaacaaagtatttcctctgaacagtcattgattcttcaagactacccttctgtgtatggaactcagtttaaaagaatttgaaacctaatttatatacaatctatacctaaatatgggagaagctatataagaaccattaagaatataaagagaatgttacattttatccctttttgtaatcatctcatctcagggtaatcaatgtgagaaaagtcttccatcataaatttaacttcattagatacctgagaattaatattgaaaatacaccatatgaatttagtgaatgtgggaaagctttcatccttattacatcttatttgatactagggaaatctcctgattaaattcacatgcatgataggcatgttggaaagtcttcagcatgaatcagatctccttcagcatgatcaaattcatactggagagaaaccttatgaatgtaatgaatgtagaaaaacttttagcctgaagcaaaaccttgtagagcataagaaaatgcatactggagagaaatctcatgaatgcactgaatgtggtaaagtgtgctctcgagtctcatctcttactctacaccttagaagtcacacaggaaagaaggcatataaatgtaataaatgtggaaaagccttcagccagaaggaaaacttcctttctcatcagaaacatcacactggagagaaaccttatgaatgtgaaaaagtttctattcagatgccaaccatcatcagacaccagaaaaatcatacaggaaccaaaccctatgcatgtaaggaatgtggcaaagcctttaacggcaaagcatatctcactgagcatgagaaaattcatactggagaaaaaccatttgaatgtaatcagtgtggaagagccttcagccagaagcaatacctcattaaacatcagaacatccatactggaaagaagccctttaaatgtagtgagtgtggaaaagcttttagccagaaggaaaacctcattatacatcagagaatccatactggagagaaaccttatgaatgtaaagggtgtgggaaagctttcattcagaagtcaagcctcattagacaccagagaagtcacacaggagagaaaccttatacgtgtaaggaatgtgggaaagccttcagtggcaagtcaaatctcacagagcatgagaaaattcatattggagagaaaccctacaaatgtaatgaatgtggaacaatcttcaggcagaagcaatacctcattaaacatcacaatattcatacaggagagaaaccctatgaatgtaataaatgtggaaaagccttctctcgaatcacatcacttattgtacatgtgagaattcatacaggtgataagccttatgagtgtaaggtctgtgggaaagccttctgtcaaagctcatctcttactgtgcatatgagaagccatacaggtgagaaaccctatggttgtaatgaatgtgggaaagccttttctcagttctcaacccttgctctgcacatgagaatccatactggtgaaaaaccttatcagtgtagtgaatgtgggaaagctttcagccaaaagtcacatcacattagacaccagagaattcatactcattaaagttctctatgaatgccttggatttagcaaaacgttcagcagattttacacttaatagtgtattggaaaattcattttacattaaagtgacatgaatgtgggaagtccttcagcagcaattcaaaacttaaatactatgatgtttaataagtattatagtgtaaagaaaacccgtacccccaaaactcccacaacaagcattatcaatgctgtacttctaggagtatactcattaaagttaggatctagtcatggacactacttaatgtgttcctggaaggcctacagatgcattaagaaatagatatgagatgtatgaggatttgaaattaagagacaaaattatcatttttgtgatgttttgctacatatatgaattgtaaaactagaatcatcaaaattatttgttgttgaagcagtcataaaactgagactgagacagaatattgaattcagaaatgtgtgcatgaatatatggggaattggtaattgatagaggcggtatcccagattggtggggaaatcatggattacttaaaaattaattgactcttcatatggaaaaataatatctcccatcataatataaaatatttttcttatgaattcttaaagtactaaagactaaaatgcaaaaagcaatacttaataatataacagttttataagaagatgtttttaaaaccttagggcaggaaagaacttctaaaacattccagaatacccggtagttccactcttgagtatggtagtcccctattttctgcaagagatggactctaagacccccagtggatacctaaaacccagataggaccaaactctatgtctatgtttttttcttatatatacatacctatgataaaatttagtttacagattagacacagcaagagatttaaaacaataataaacataatatggaacaattataacaatatactgtaatcataaaagttatgtgaatatgatctttctctcagaataccttattgtactgttctcaactatttatgaactgtggtgactacaggtaactgaaaccatggaaagcaaagctgtggataagggggaactactatatatatgcatctacccaagaaacatgaacacagggagtcatgtactggtctatagctgtatagttcattgcaccatgagttatagtagccagaagttgggaaacaaatgctgtctcttgtgaaatagatgaataaaatgtgatagtaacatagtagagtactctctagcagttaagtgacaaattaagtctatatattaacagaaatatttttaaaaaattagagtgaagaaaaatgatgaacatattgtaatgatgcttctgtgaatttgaataaaatcaacactaaccagccctagtactaagaattggttatggataaattatgtaaaactaaagaatggattgaaaggatatgtatatactcagttcccaaaagtggagtggttacctctaggaagaaaggaggtggaagggaaatgttaccaagcatggtagttaaaggatacttcaattttgtatctatttcttattaaaaagaaacattctaagtaaacataacgaaatattaattctgggtggtggtaatatttgtgttcattctatcattcgtgctatttatttccttaaacttctgaaagttaaaaagtccagataggagtgaggaagctgtacatgaaacataatggacttacattcctagtcagatactaatattctgtagaagatatttctaaaatcttatctttaaaatatgaaataatttttaattggggtggcaacttaaattcaattaaaataactcatgtgtcacaagagtaaattttacataatctgtacgtagttctaatctgtatatagtcttggaggttatgatttgccacagattggttggatcacatacatttaaggatcatattattaaataatatatgcacagacatggagagaattagtttttactaaaacatttatcagaaattttaatactctgcataaccagtattagcattagaaattagccacttttaaaatgagaaaactgtgtcactcttcaatttttttataagccattgaggaaaacattaactcctggatttcagcttcacttttaacctgcagactaaatttctttctcaattatgtcagacacacccaagtcaatcccaacccccttgttaccttgggaagaccgtgctg

SEQ ID NO: 201929 - DNA, 4174 bp, Homo sapiens
  Payload ID: 19836
  Gene Name: zinc finger protein 260
  Uniprot ID: Q3ZCT1
  ENST ID: ENST00000588993
  CDS Start-End: 715-1953
gctgctttgttccccaaccataacatccaagtccagtgtcatttttctgctcacaagtttaaagtcagcacttaaaagaacagcaacagatgattgagaaagaaatgtaaagaaggttctctttgtgtgagtaagcaagaacctgagacaaggtcatactctgtcacctaggctggattgcaatggcatgatcatagcatactgcagcctcgaactcctgggctcaagcgatcctcctacttcaacctcccaaaagaagcctgggaagtttataaacagataaagacgcaacatgaaagacttgtaagttaagtctcatctttctctgtgaaaagacagactgagggaaaatttaggaaacaaagtatttcctctgaacagtcattgattcttcaagactacccttctgtgtatggaactcagtttaaaagaatttgaaacctaatttatatacaatctatacctaaatatgggagaagctatataagaaccattaagaatataaagagaatgttacattttatccctttttgtaatcatctcatctcagggtaatcaatgtgagaaaagtcttccatcataaatttaacttcattagatacctgagaattaatattgaaaatacaccatatgaatttagtgaatgtgggaaagctttcatccttattacatcttatttgatactagggaaatctcctgattaaattcacatgcatgataggcatgttggaaagtcttcagcatgaatcagatctccttcagcatgatcaaattcatactggagagaaaccttatgaatgtaatgaatgtagaaaaacttttagcctgaagcaaaaccttgtagagcataagaaaatgcatactggagagaaatctcatgaatgcactgaatgtggtaaagtgtgctctcgagtctcatctcttactctacaccttagaagtcacacaggaaagaaggcatataaatgtaataaatgtggaaaagccttcagccagaaggaaaacttcctttctcatcagaaacatcacactggagagaaaccttatgaatgtgaaaaagtttctattcagatgccaaccatcatcagacaccagaaaaatcatacaggaaccaaaccctatgcatgtaaggaatgtggcaaagcctttaacggcaaagcatatctcactgagcatgagaaaattcatactggagaaaaaccatttgaatgtaatcagtgtggaagagccttcagccagaagcaatacctcattaaacatcagaacatccatactggaaagaagccctttaaatgtagtgagtgtggaaaagcttttagccagaaggaaaacctcattatacatcagagaatccatactggagagaaaccttatgaatgtaaagggtgtgggaaagctttcattcagaagtcaagcctcattagacaccagagaagtcacacaggagagaaaccttatacgtgtaaggaatgtgggaaagccttcagtggcaagtcaaatctcacagagcatgagaaaattcatattggagagaaaccctacaaatgtaatgaatgtggaacaatcttcaggcagaagcaatacctcattaaacatcacaatattcatacaggagagaaaccctatgaatgtaataaatgtggaaaagccttctctcgaatcacatcacttattgtacatgtgagaattcatacaggtgataagccttatgagtgtaaggtctgtgggaaagccttctgtcaaagctcatctcttactgtgcatatgagaagccatacaggtgagaaaccctatggttgtaatgaatgtgggaaagccttttctcagttctcaacccttgctctgcacatgagaatccatactggtgaaaaaccttatcagtgtagtgaatgtgggaaagctttcagccaaaagtcacatcacattagacaccagagaattcatactcattaaagttctctatgaatgccttggatttagcaaaacgttcagcagattttacacttaatagtgtattggaaaattcattttacattaaagtgacatgaatgtgggaagtccttcagcagcaattcaaaacttaaatactatgatgtttaataagtattatagtgtaaagaaaacccgtacccccaaaactcccacaacaagcattatcaatgctgtacttctaggagtatactcattaaagttaggatctagtcatggacactacttaatgtgttcctggaaggcctacagatgcattaagaaatagatatgagatgtatgaggatttgaaattaagagacaaaattatcatttttgtgatgttttgctacatatatgaattgtaaaactagaatcatcaaaattatttgttgttgaagcagtcataaaactgagactgagacagaatattgaattcagaaatgtgtgcatgaatatatggggaattggtaattgatagaggcggtatcccagattggtggggaaatcatggattacttaaaaattaattgactcttcatatggaaaaataatatctcccatcataatataaaatatttttcttatgaattcttaaagtactaaagactaaaatgcaaaaagcaatacttaataatataacagttttataagaagatgtttttaaaaccttagggcaggaaagaacttctaaaacattccagaatacccggtagttccactcttgagtatggtagtcccctattttctgcaagagatggactctaagacccccagtggatacctaaaacccagataggaccaaactctatgtctatgtttttttcttatatatacatacctatgataaaatttagtttacagattagacacagcaagagatttaaaacaataataaacataatatggaacaattataacaatatactgtaatcataaaagttatgtgaatatgatctttctctcagaataccttattgtactgttctcaactatttatgaactgtggtgactacaggtaactgaaaccatggaaagcaaagctgtggataagggggaactactatatatatgcatctacccaagaaacatgaacacagggagtcatgtactggtctatagctgtatagttcattgcaccatgagttatagtagccagaagttgggaaacaaatgctgtctcttgtgaaatagatgaataaaatgtgatagtaacatagtagagtactctctagcagttaagtgacaaattaagtctatatattaacagaaatatttttaaaaaattagagtgaagaaaaatgatgaacatattgtaatgatgcttctgtgaatttgaataaaatcaacactaaccagccctagtactaagaattggttatggataaattatgtaaaactaaagaatggattgaaaggatatgtatatactcagttcccaaaagtggagtggttacctctaggaagaaaggaggtggaagggaaatgttaccaagcatggtagttaaaggatacttcaattttgtatctatttcttattaaaaagaaacattctaagtaaacataacgaaatattaattctgggtggtggtaatatttgtgttcattctatcattcgtgctatttatttccttaaacttctgaaagttaaaaagtccagataggagtgaggaagctgtacatgaaacataatggacttacattcctagtcagatactaatattctgtagaagatatttctaaaatcttatctttaaaatatgaaataatttttaattggggtggcaacttaaattcaattaaaataactcatgtgtcacaagagtaaattttacataatctgtacgtagttctaatctgtatatagtcttggaggttatgatttgccacagattggttggatcacatacatttaaggatcatattattaaataatatatgcacagacatggagagaattagtttttactaaaacatttatcagaaattttaatactctgcataaccagtattagcattagaaattagccacttttaaaatgagaaaactgtgtcactcttcaatttttttataagccattgaggaaaacattaactcctggatttcagcttcacttttaacctgcagactaaatttctttctcaattatgtcagacacacccaagtcaatcccaacccccttgttaccttgggaagaccgtgctg

SEQ ID NO: 201930 - DNA, 3830 bp, Homo sapiens
  Payload ID: 19837
  Gene Name: zinc finger protein 263
  Uniprot ID: O14978
  ENST ID: ENST00000219069
  CDS Start-End: 877-2928
gccactgactgggcgggcggctagctccctggcctccccgacatgccgaggagcccctggcttccggagccgacgaggccgcaggggccaatgggaccatcttcagccagcccagagtagccgaagcgggtggggcctggcttgggaaaggattcatccggggaagctgattaacaattcagatttccgggtctcaccccgacactgacgcactggagagcgcgtggccctgggatctgcgttttcccaagcgctccggagtaattctaacccaggttgcccgccagtcacaacgacctcaggcttgttttcttcgcttggatccagctgccctgcccccagtcactcccagaatttcagggcgcgccccgtggccccgcctctcgtctccaattggtccctcgctcatccagtccccgtaggccaatcttcccttctcattggtaggcggtgagtgtgtggagaaacctgacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagagggcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaa

SEQ ID NO: 201931 - DNA, 1721 bp, Homo sapiens
  Payload ID: 19837
  Gene Name: zinc finger protein 263
  ENST ID: ENST00000538765
  CDS Start-End: 255-1250
ctgttttgcaacttcttgtttatgagcctggaagccacgaagtggtgggaaatacgagattcaaatatctggtggccgtgtgacgagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagac

SEQ ID NO: 201932 - DNA, 851 bp, Homo sapiens
  Payload ID: 19837
  Gene Name: zinc finger protein 263
  ENST ID: ENST00000575823
  CDS Start-End: 1-347
ggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacagagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccaca

SEQ ID NO: 201933 - DNA, 1139 bp, Homo sapiens
  Payload ID: 19837
  Gene Name: zinc finger protein 263
  ENST ID: ENST00000574253
  CDS Start-End: 310-990
ccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttc

SEQ ID NO: 201934 - DNA, 1636 bp, Homo sapiens
  Payload ID: 19837
  Gene Name: zinc finger protein 263
  ENST ID: ENST00000573578
  CDS Start-End: 314-763
atttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacagcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactgggtaaggacttcttttccagggatgatgactgcgccatttctgaccagggtcctgcccgttattcattcacctcctggacacagactctgagttttgccaagaagcctccacaggagacttccctttgtctaaagtcccctgtacgagagtcatgtatctgccaagtggtacagttggcacaggcagcccgggactggagtcccagctgccagagcctaaggcgagtctgagccatgtgcacttcctagggcagagcaaacccaatgcggtgacaacctgccagcatcacacacatgcagtattccaggatgctggggggctctaaatggttgattccttgcaattttcagatgcttattcttatgagctcgccagtgtttcctgtgttccgttagtgtttctaggctcgtccccaaagacaaaaatttcaggggtagtaggatcaacattccagcctatcatctctcacagcccataaaaattcagaaagtggggagggtcttgtggaaatttggaaacaatgtatagctccaaagtaggccatatcataaattaagatttacctatgtcttgtactgtactcagagttttaaaattatgcctacggaatatgacagactgacatatagttggatttaggtggaggatatgcttgtatttattgtacaattccctcaacttttctgtatgtatgagaattcttttaataaaaagttggggaagtcttaacataaa

SEQ ID NO: 201935 - DNA, 2637 bp, Homo sapiens
  Payload ID: 19837
  Gene Name: zinc finger protein 263
  ENST ID: ENST00000575332
  CDS Start-End: 1-347
aggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacagtgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccacatttttcaagaatttctctataatccccatgttctaagccttgaaaatcatattcaggttcctttttgtaaagaagattttcccatgcatttgctatggttatttgttttacttcttcccaactttttgcccagttaaaaattgcactttttatattgtagattttaattttggaaactcctttatctcctttctcttgctcatcatcactttcttcaaatattacaagactctcttcaagttgcttccatctatacagccgtttgcagctcaagatcacaccttgattcattggttgaatcaaggttgaagtgttatgggggaagaacatacattttattcgaccatcctcactggttagggattcagaggaaggatgagccgggcaactgtccagaagtaacaatgccctgacgtcctcgtcatgaaatcttagaacattaagttgaaaatgtcggacctcaggaacaaagttttgaaaaaaccattctgaaaacaattctctggtgaaccaaacatctttactgggtttatatatcacaggcaatgtacttgtgtcctctttcacacttttgggcagttttgattttccaataatgattgactttaatttatgagttccgtctgcatttgcacataaaaaggcagacaacctttctttgtttattttcttccctggtaggcagatatctttcctacttgcctgagaattttctggcattgacttccaaaagaggtctgtttcatccccactgtatagctgagctagacacagtttctcctctttgattatcatggacagtttttgtcgaaatggctcaacattttcagaaactgaacttaggacttgttccccacatccttttcggttcccaattgcatgccgatttcgaaatctaaaaagccaaccagtgctagctttgaaatctgttcgcccaaaacaccgtgcaaatctctctgcagcagcctgaagctccacgcctcttaccggaacaccggctgagcgtttctgttggtaccacatgtagaccgcatcatctacatcaccatatttggctcccgttgtcctctttctcttctcagcccctactaatggcatgtcctgcttcagtacaaagtccagaattaacttcttattttttttaatgtcataaaatgttgacttactgattccaaattcatccattacacttttaagtgatcgtccagcttcaattctacttagaaccttcattttctcctccaaattcagtgttgtatatttccctctcttattcatactgaatttaactctgaaccaccaacaggagaaaacaaagggaaaagccttaatgaattggcaaaaaaaaaacccacattttttaaacaaaacttagctgaaagccccagaaggcatgggcattgtattggaggataatggactgaaggggctaaccatgactgaagagctagtctagaggtggaggtcttatgcactcagaaagctgccagttgcaaagtcctgtctggctcttgctcctgcaagccatgagtgatcatttttcagaatgccccctacctctcctctcttttgacagatacaacagcctcagtcaggaatgacaggaatacctgcatactttccctaactcaataccggaaaacggacaatatgaagagaggagggatggagcaagatgtgcccacaagacaggtgtgataagtttccataaaaactgatgcttcagaagaagggagcgtgaaagactcaaaggcaatgacagagtaatcttgtgtgtagcagagatgcaatgtggcttctccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgt

SEQ ID NO: 201936 - DNA, 691 bp, Homo sapiens
  Payload ID: 19837
  Gene Name: zinc finger protein 263
  ENST ID: ENST00000574674
  CDS Start-End: 1-156
tgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacagtgtgaagtggaatctctgaaactcaggtgtggcatcaacaaagtcaagaagatacaacagcctcagtcaggaatgacaggaatacctgcatactttccctaactcaataccggaaaacggacaatatgaagagaggagggatggagcaagatgtgcccacaagacaggtgtgataagtttccataaaaactgatgcttcagaagaagggagcgtgaaagactcaaaggcaatgacagagtaatcttgtgtgtagcagagatgcaatgtggcttctccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgtg

SEQ ID NO: 201937 - DNA, 759 bp, Homo sapiens
  Payload ID: 19837
  Gene Name: zinc finger protein 263
  ENST ID: ENST00000572748
  CDS Start-End: 335-759
acgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacagttgcctgagagcttagaggacgtggcaatgtacatctc

SEQ ID NO: 201938 - DNA, 12163 bp, Homo sapiens
  Payload ID: 19838
  Gene Name: zinc finger protein 264
  Uniprot ID: O43296
  ENST ID: ENST00000263095
  CDS Start-End: 415-2298
attttcttctgcacttctgtctggagaggtctgtagccactgagggccccggtcggggccgctttgcaggtccctagtcaggaccgagcaggggagtaggataggaatccccgccgcacctttgtacgagcctgaccccttccgtgggtttgttcctgggtcgccgtcaagctgcggtctctcctcccccgcccttcagccccgcggtctccaggggcggcgccctgggtctggaacgcggttgccaccgaggaggcggcggccctgcgtctggaacgccgttgccaccgaggaggcggcggccccgagcgcgcctggaagccccgggcaaccggccagggtcgggcacaggtggggtccgtcaggccgcccggggctcctctgtcccagctctgcggcccagggggtgacgtgatggcggcagcggtgctgacggaccgggcccaggtgtctgtgacctttgatgatgtggctgtgactttcaccaaggaggagtgggggcagctggacctagctcagcggaccctgtaccaggaggtgatgctggaaaactgtgggctcctggtgtctctggggtgtcctgttcccaaagctgagctgatctgccacctagagcatgggcaggagccatggaccaggaaggaagacctctcccaagacacctgtccaggcgacaaaggaaaacctaagaccacagaacctaccacttgtgagccagccttgtcagagggaatctcacttcagggacaagtgacacaaggaaactcagtggactcacagttggggcaagccgaggatcaggatgggctatcagaaatgcaggaaggacacttcagaccaggaatagatccccaggagaagtctcctgggaagatgagccctgaatgtgatggtttagggacagctgatggtgtgtgttcaaggattggacaggagcaagtctctccaggagatagagtccgtagccataactcatgtgagtcaggtaaagatcccatgattcaggaagaggaaaataactttaaatgcagtgaatgtggaaaagtatttaacaagaaacacctccttgctggacatgagaaaattcactctggagttaagccctatgaatgcacagaatgtgggaaaacctttattaagagcacacatctcctgcaacatcacatgatccacactggggagaggccctatgagtgcatggagtgtggaaaggccttcaaccgcaagtcataccttacccagcaccagcggattcacagtggagagaagccttacaagtgcaatgaatgcggaaaggccttcacccaccgctccaattttgtcttgcataacaggagacacactggagaaaaatcctttgtgtgcacagaatgtggccaagtctttcgacataggccaggctttctccggcactatgttgtccacagtggtgagaatccctatgagtgcttggagtgtggcaaggtcttcaaacacaggtcatatctcatgtggcaccagcagactcataccggggagaagccctatgagtgcagtgaatgtgggaaggtcttcttggagagtgcagccctgattcaccactatgtcatccacactggagagaagccctttgagtgcctcgagtgtgggaaggctttcaaccaccgatcctacctcaagaggcaccagcggattcacactggggagaagcccttcgtgtgcagtgaatgtggaaaggccttcacccactgctctacttttatcttgcataaaagggcccacactggagaaaagcctttcgagtgcaaagagtgtgggaaagcctttagcaatcggaaggacctcattcgccacttcagcatccacactggagagaagccctatgagtgcgtggagtgtggaaaggccttcacccgcatgtcgggcctcacgaggcacaagcggattcatagtggagagaagccctatgaatgtgttgagtgtgggaaatcgttttgctggagcacaaacctcattcgacatgccattatccacactggagagaagccctataaatgtagtgaatgtggaaaggccttcagtcgcagctcgtccctcactcagcatcaaaggatgcatactgggaaaaatcccatcagtgtaacagatgtgggaagaccttttacaagtggacaaacctcagttacccttcgagaacttcttttagggaaggactttttgaatgtaaccactgaggcaaatattttgccagaggaaacatcttcctctgcatctgatcaaccataccaaagagaaaccccacaagtgtcttcactgtgagaaaaccttctgttgctgaatattacttgtcatctgaagagtcatattagaaattcgttcagtctagagccttattctccatctgataatttatcctggagagagacccagtggttattgtgcacataggagaaccttcagctgcatctttctccttagtttacagtgcaattttatctcaggaattatttttaaaaggaggaggggacatagaaaaaatgaaatgcaagcacacatcttttcaggcttctctgccaagcctatggcgctttgtcatggatttcttagtgtatttgggggaagggaaatgtttcaaggtaaagaaccttgaccctttatgtgcttgtatgtacatttattgctatccagtgtcagaacagttagtttaggaaaagtatgcaaactttaatcgcacatcttctgtattccacaatagtacttactcttgagaagcataactttatgacaacttagggggcttgagccatgaaatactcacgtttaagtcagtaaggatacacatgttaacattcaggcttttgtcttgatgcccgtcttttggtttacgtcatcattgtagccatatggtaaatttttatttgttaaatttttaaaaattacttagctcaaaatgtcagtggtaaatttttaaattgagtaaagtgattcttctttgctcttatttaaaatcgacagcatttctagttcctttgacattccatataatttttaggattagtttgtacttatttacaaaacagtcttgttcagatttttacagaaattgagttaagtctgtggattaatctgttaagaattggtatctttactatgttgggtcttgtagttcatgagtgcaggagtaggcctcttaatttataatagttaagcattccttaaagtatttcattaatgttaaaaattttcagcgtatagatccctatgcatttttgttagaatttgcatcctagggtgcttttttgtttgtgtgtgtgtgtaatttgagtgattgtaaatggcattgatgtttgaactttgaattgcacacaatttttggtagtatacagaaatataatatttttggacattgttttgctaccctgcaaccttattgagttcacttattatttttagctatttctttcgacagaatccttggaattttctatatagaaatgtcatctgcaaatacagaccattttttatctttcatcttacctgtaatataccttttatttcctttttgtttgtcttattgcattgcacaagctgggacttccattatagcgttgaataggaatagtgagaaaggccatccttacctggttcctgatagtaggggggacaatgttcagttttttgtttttttgttttttgtttgagacagggtctcgctctgtcacccaggctggagtgcagtggcacgatcttgtctcaccatagccttaagttcctgggctcaagtgatccccccacctcagccctcaccaccccccagtagctggtactacaagcatgcaccaccagtcccagctaatttttgtattttttggtagagacagggtttcaccatggtgcccaggctggtcttgaactcctgggctcaagcaacctgcttgcctgggtctcccaaagtgctgggattacaggcgtgagccacagtgcacagcatgttcagtttttcatcatgaagtataatgtaagttttataaaacatatgtcctctataagggtaaaaaatttcctctgttcccagttttctgagactctgtgttgctatgaataagtgtggaattttgttcagtactttttctccaccagttgatgtcattatgctattttccttctacatcctattgatggaatgtattgctttgatcaagttttgaatattgagccagccttgcatccttagaataaaccatacttgtttgtagagtataattgtttttatatatcatttgacatcattccctttgtttgtattttgttgaggaaatattcctctaatttattggctaataatgtgtagttcttttttcttttgtttcttatgttctaaatgtcttatgtgtggttttgatgtctaggtgatcttgacctttcaacatgaattggaaggagttctcttctaatttttggaagactgtgtagaattggtgttatttgttcttgtcatgtttgatgacctctagtcaaccattgggccagagatttttcttctggaggcttttaaattacatatttattttattggataggtagaactattcgaagtatctatttcttgtgtaataaattttgatagtctgtcctgttgaaggaatatttcatctgtatttgtagcactcccttattcttttgatagcaggatctgcacttctttttatttttaatatttaaaatgtgcatactcattttatgattgagtcttcttagacatttatcagttttattgcgcatcatgctgaaagatgtaatttttgcttcatctctcacttcagagaactagcactttatattaatgatttgtctctattcttgatttctttgatttctgctctgatcggtattatattccacttgctttggttgtatttggctctttctaacttttcaaggtggggttttagattattgatttgagatttttttgcttttttaatgtaagcattacattgtataaatttacctcatatcactattggtttgatcccacaagttttaatgttttcattacattttaattctaatagtttttattttttgagacattctctcttagccatgaattatttaatagtatgcttaattttctggtgtttggcatatttgttactgatttctaatttgttccatgtttgatctgactgtttaaatgtgttaacatttttttatgacccaggatagggtctatcttgtttcgtatagctgcttgaaaagaatgggtgttctgctgttactgggtggagtttctataaatgtctctatgatcctgctcattgttattcaagtcagctatgtccttgctgattttctgtccagcatttctgtcagttgctgagaggggtgttgaagtcctgaacataggccgggtgcagtggctcacgcctgtaatcctagcactttgagaccactaaggcaggtggatcacctgaggccaggagttcgagaccagcctggccaacatggcaaaaccctgtctactaaaaatacaaaaattagccaggcatggtggcgtgtgcctgtaatcccagctgctggggggctgaggcaggaggatcagttgaacgtgggaggcagaggttgcagtgagctgagatctcaccactgcactccagcctgggcaacagagcgagactctgtctcaacaacaacaacaaaaagtcctgaacatgattgtggaagtgtgttgctctttcaagttctatcactttttgtttgcaaagttcaaagctgtattgtttggtacatatacatgtaggtttgccaagtctttgtggtgaattgactcttctgtcattatgtgatgtcatttttttgccttttaatagtcttgtcaatactttacctgatgttctcatagtgactcctgcatattttgattaatgtttgcatggttaatatttcttcattttattttaaagcttacctgtatcattacttatgaagtcagtttctttgaacagcatatactcaggccatgctttttttattcattctgcatatgtctctcttaattggtatgttgaaatgatttacattaaaataattattgatattttagggcttaagtgtgcccttaaatgatttttgtgttcttttttattgttcctctgttatttggggttgtttactagtcttcctataggttacttcaccttttttttttttaataatttgatttgatacatatgtagtgttttttagtatagatcctccttgacttatgatggggttatgtcacaataaacccattgcaagttgaaaatactatgtcaaatatgcatttaatacacctaccctgctgaacatcatagccgatcttgccttcagaatgctcagaaaatttacattagcctgcagttgggcaaaatcatctaacacaaggcctactttataataaagttactgcaaagaattttaaataaaaattcaagtgtggtttctactgaatgcatgtcgcattcgcaccattgtaaagtcaagtagtaagtcgaaccatcctaagtcagggactgtctgtatatatctgcattttttagtgattgttctactattacagtgtaaatatataacttatgacagtttaataagttatcagcaatttagcactttacttccattaggttcctttagcttacctactaatgtaactatcttaagtaatagtaattcctcttcaaaaattgagcgctatgttgcaagatgtaatttttcttttccttttttttgagaccaagtctcactctgtcacccacgctggagtgctgtgatgcgatctcggctctctgcaacctctgcctcccgggttcaagcaattaactgcctcagcttccctagtaatggattacaggcgcccgccaccacgcctggctaatttttgtatttttagtagagacggggtttcaccatcttggccaggttggtcttgaactcttgacctcatgatccacccgcctcggccccccaaagtgctggggttacaggtgtgagccactgcacccggccacaagatgtaatttttactttatctctcacacgtattttacaaaacgtcatgagaaacattgtctcttgaccttttttttttttttttttttttaaagagacagagtctcactctgtcacccaggctggagtgcagtggcacgatcttggctcactgcaacctccgcctcctgggttcaagcgattctcctgcctcagcctcctgagtagctgggattacaggtgtgcgccgccacacccagctaattttgtatttttagtagagacggggtttcaccatgttgctcaggctggtctcaaactcctgaccttgtgatccgccaaccttggcctgtcgacctctttacccattccattgttcattcttctttcttgaaatcccaaaccttctattaacatttcttttcagttatacactgaactttactgtagcctttcttctagagtaacaaatgttctttgttttccttcctctaaagatgtctttatgtttccttcattcccaaagaatatttttgtggaatataagattcagagttggcagttgttttcttttagacttcagagatgtatctctctgttctgtacattattgtttaatataagaaacctactagcattcaaataatcattccctattttacaatgcatcagttctgtcaagcttcattcaaagtgtttttcattgtctctagtgttcagaagtttggctgtgatgtgcgtggcatggaagtttttgggtgtattctatttggcgctccctggtgcttgcccagctttttgatctgtaggattatgccttttgcaaaatttggggaactttcaactattatttcttcaaatattttttcaccccccagtcttgtcttttttagggacttcaataacatgagtggcagatcttgttttacactcccatgggtccttcaggctctcatcttttttctttttccagtctattttctgtcttgttaatattgattaatttttattgaccttccatggtcctcactgattgttttctttgtcatacctaatctgttgagtttgtgcagtgagttttcattttggttttgtattttccagttgtttaatttccattgggtgggttcttttgtacaccttctgtttctttgcttattttttaacgccaaagaaagactctcagagaatagacaactatattccaaagtcatggttctctggtggtttgtcttgacatttgaatagaaatgttaaactatctgggggaatagaaagcccacagtcttctgagttgtgctacaccaatatttctatgaacagatcttacaactgagagtgatctgcagatttttcagagtcatgttctccatggaatgtttgtaaaattccctagctctctgcactgagctgagatcgtgccactgcactccagcctgggcaacagagcgagactccatctcaaaaaaaaaaaaaattctctagctctctatgccttgttgtatcctcaggaaggagtcacctctcttccaggatcactcttgccttttgttattggacacattttcctacctcctgcccagtcttttttaggctctctgtcatacttcctcgcctagtctttaacttgtctctgataaccagatttttcccccataatctgtatctgtattcaagtctctatcctcatccccaaatggatttcaccccgcttgtccatcagtctctgcccatttcttctgtctcccacagacatggtctgtgtagttgttctgcacactacccgtcctcgccccttctcatttccctcactccacggacagctacaggagggcttccatcatttgtcctcttacttccttgttagaactttgtgctgctgaccaccactctgaaccaaaacttctttcttggttcttgaaagttgctgtctttctcctccagagggtctgtgtcttccttccaactcttaaacatttttgtttcccagaatccatcattggccattgctttttcacttgccatgagctctgtgaatgagatggttcctgctgaagacatttactttcaatgatctacagaatttcccaaatctatgtctccagactggatgtttctcacgtctgtggcccactgggcatcttctgcactttctctgcatttgtaaacactgagcctgtatgcgtgtctatgtggccatggccctggccgtggggatgcacccataattataatgagagcaggtgaatgtcatgtggctatgtatgagacattgttgtgaatgttttacatgcatcagctctttcaacatttacagcatctgtgtgtggtaggtaatgttgtttccttcattttgcagagcagaatatagataggctcaggttaagaatttgcccaaggttacacagttatgaagtttggatttaggaatgggaggccacgtagactggcttcagaattcatgtctttaaccactttattgcttctcatgttggggggtttgttttctggtcactatttttactaaagttgattcaacaatgctataatctgttactctcattcgacaatacatcttgactgtttcttcaacttgaggaaggtaaaccaaagccactctttaatgggtgcaaatatctgttgtaactatgtagaagatacagtgtctgggtttgaggacaggggagtgggaaaactgagtagggaagcggtaagacatgcatctggctttaggagtgtttgaagtgcctaaagatcagggtgaatttcccaaatttgaatcttgttgcccaagccacattgcaaccacctctttttctcttacctcgtccccacatccaggcactgccccattctgttcattccacctttttttttagtagaccctccatatatgtgtgtgttttggtgaatggccacacacagcaaagttatttttattgcaattttgttgttgttgtttgagacacagagtctcatactctgccacccagactgaagtgcagtggtgcgatctcagttcactgcaacctccatccccccatgttcaagcaattctcctgcctcagcctcccaagtagctgggattacaggcatgggccaccatgcccggctaatttttgtattttttgtagacacggggtttcaccatgttggccaggctggtctcacactcctgacctcaggtgatccacccgcctcggcctcccgaagtgctggcattacaggcatgagccaccacacccagcctttattgcaatttttggttccctcacagaatgtttaccatgaagctgtgcgtataggtggtaccatgtatgacataccttgacctcaaagataatctacctgggctttttttgtttgtttgttttgagatggagtctcactctgtcacccatgctggtgtgcagtggcgtgatcttggctcacagcagcctctgcctcccgggttcaagcgattctcctgcctcagcctcctgagtagctgggactacaggtgcctgcgaccacacccagctaatttttgtatttttagtagtagtgggatttcaccatgttggccaggatggcctccacctcctgacttcatgatccacccgcctcggcctcccaaagtgctgggattacaggcgtgagccaccgcacctggcctacctgggcttttttggacagatgtacatgattttagaaattgttatgaatgactgtcttgggatcctcaagaacacccccaggtttgacgatttgctgagaagactcaggtctcagcattctgtcatactcaacagctatgatttactgcagcaaaaaaatacaaagcaaatagtaaagggaaaaagccaaaattcagagaaaaccaggcacaatcttctgagtcttgtttcagtgaagtcacaggatgtgccttatttaagttccatctggtacttatgacaacacatgctatatgtccactgggaagcttattagagactcagtgccagggtttttattgggcatgttttctagcacatcccacaattctggacttccagaaggttagcaggggttcagcttttcagctgaaaacgttatccccctttcagctggggggaaaaaaaggcaccgaaaaacagggcagtgagctactcctgttttgggtgggtggagcagtagtaagcctcccaaaatctaaggtcccacactccagcaagggtgaaccttgcaaactcaaaaggatagcagtctccaacctgctgttttatacagtgacttaagtggtactaaaatgctatataagtcaaatttacgtaacattaagcaaataattttttttcagcaaaaaaataatggtcatgactttgtggtgaaggcttatgtaatgattgtaataaattcaggtggctcacgcctgtgataccagcacttttgggaggctgaggcgggtggatcacttgaggtcaggagtttgagaccagcctagccaacatggtgaaatcccatctctacaaaaatgaaaaattagccgggcgtagtggtacatgcatttagtcctagctacttgggaggctgaggcaggaaaatcgcttgaacctgggaggcagaggttgcagtgagccgagatcatgccactgcactccagcctgggtgacagagtgagactgtgtctcaaaaaaaaaaaaaaaaaaaaaatgcctcagttttgttaagaggaaaaagcaaatcctaagttacagtggaacttatgaacaccctagcctagagatttaatttagtgatgaaaaggtacagagagagtctttcaagaaaggacctagtctgctcgcgttctctctctctctctctctatatatatatatgtatatgtgtgtgtacatatggaccacttcaagctacacacacacacacacatatacacgtgtatgaatatatatatatggctataagtggtgcgacttgcaggtactccctttgttcacctttgtaaagatgttattgccagttcagtgtgtatttctatagtatatatgtaaacaatttgtcatccttttgttgctgcttttgaaactagttcatggcttcagtgggggagagatttaaataatatgggtttataatttctgcattattaaatgcagataacttgtgattaaagagtatgttattggaa

SEQ ID NO: 201939 - DNA, 2078 bp, Homo sapiens
  Payload ID: 19838
  Gene Name: zinc finger protein 264
  Uniprot ID: O43296
  ENST ID: ENST00000536056
  CDS Start-End: 57-1940
acgccgttgccaccgaggctcctctgtcccagctctgcggcccagggggtgacgtgatggcggcagcggtgctgacggaccgggcccaggtgtctgtgacctttgatgatgtggctgtgactttcaccaaggaggagtgggggcagctggacctagctcagcggaccctgtaccaggaggtgatgctggaaaactgtgggctcctggtgtctctggggtgtcctgttcccaaagctgagctgatctgccacctagagcatgggcaggagccatggaccaggaaggaagacctctcccaagacacctgtccaggcgacaaaggaaaacctaagaccacagaacctaccacttgtgagccagccttgtcagagggaatctcacttcagggacaagtgacacaaggaaactcagtggactcacagttggggcaagccgaggatcaggatgggctatcagaaatgcaggaaggacacttcagaccaggaatagatccccaggagaagtctcctgggaagatgagccctgaatgtgatggtttagggacagctgatggtgtgtgttcaaggattggacaggagcaagtctctccaggagatagagtccgtagccataactcatgtgagtcaggtaaagatcccatgattcaggaagaggaaaataactttaaatgcagtgaatgtggaaaagtatttaacaagaaacacctccttgctggacatgagaaaattcactctggagttaagccctatgaatgcacagaatgtgggaaaacctttattaagagcacacatctcctgcaacatcacatgatccacactggggagaggccctatgagtgcatggagtgtggaaaggccttcaaccgcaagtcataccttacccagcaccagcggattcacagtggagagaagccttacaagtgcaatgaatgcggaaaggccttcacccaccgctccaattttgtcttgcataacaggagacacactggagaaaaatcctttgtgtgcacagaatgtggccaagtctttcgacataggccaggctttctccggcactatgttgtccacagtggtgagaatccctatgagtgcttggagtgtggcaaggtcttcaaacacaggtcatatctcatgtggcaccagcagactcataccggggagaagccctatgagtgcagtgaatgtgggaaggtcttcttggagagtgcagccctgattcaccactatgtcatccacactggagagaagccctttgagtgcctcgagtgtgggaaggctttcaaccaccgatcctacctcaagaggcaccagcggattcacactggggagaagcccttcgtgtgcagtgaatgtggaaaggccttcacccactgctctacttttatcttgcataaaagggcccacactggagaaaagcctttcgagtgcaaagagtgtgggaaagcctttagcaatcggaaggacctcattcgccacttcagcatccacactggagagaagccctatgagtgcgtggagtgtggaaaggccttcacccgcatgtcgggcctcacgaggcacaagcggattcatagtggagagaagccctatgaatgtgttgagtgtgggaaatcgttttgctggagcacaaacctcattcgacatgccattatccacactggagagaagccctataaatgtagtgaatgtggaaaggccttcagtcgcagctcgtccctcactcagcatcaaaggatgcatactgggaaaaatcccatcagtgtaacagatgtgggaagaccttttacaagtggacaaacctcagttacccttcgagaacttcttttagggaaggactttttgaatgtaaccactgaggcaaatattttgccagaggaaacatcttcctctgcatctgatcaaccataccaaagagaaaccccacaagtgtcttcactgtgagaaaaccttctgttgctgaatattacttgtcatctgaagagtcatattagaaattcgttcagtctagagccttattctccatctgataatttatcctggagagagacccagtggttattgtgcacataggagaacctt

SEQ ID NO: 201940 - DNA, 359 bp, Homo sapiens
  Payload ID: 19838
  Gene Name: zinc finger protein 264
  ENST ID: ENST00000594126
  CDS Start-End: 243-359
ttttcttctgcacttctgtctggagagccccgcggtctccaggggcggcgccctgggtctggaacgcggttgccaccgaggaggcggcggccctgcgtctggaacgccgttgccaccgaggaggcggcggccccgagcgcgcctggaagccccgggcaaccggccagggtcgggcacaggtggggtccgtcaggccgcccggggctcctctgtcccagctctgcggcccagggggtgacgtgatggcggcagcggtgctgacggaccgggcccaggtgtctgtgacctttgatgatgtggctgtgactttcaccaaggaggagtgggggcagctggacctagctcagcggaccctgtac

SEQ ID NO: 201941 - DNA, 681 bp, Homo sapiens
  Payload ID: 19838
  Gene Name: zinc finger protein 264
  ENST ID: ENST00000597447
  CDS Start-End: 392-681
gagaggtctgtagccactgagggccccggtcggggccgctttgcaggtccctagtcaggaccgagcaggggagtaggataggaatccccgccgcacctttgtacgagcctgaccccttccgtgggtttgttcctgggtcgccgtcaagctgcggtctctcctcccccgcccttcagccccgcggtctccaggggcggcgccctgggtctggaacgcggttgccaccgaggaggcggcggccctgcgtctggaacgccgttgccaccgaggaggcggcggccccgagcgcgcctggaagccccgggcaaccggccagggtcgggcacaggtggggtccgtcaggccgcccggggctcctctgtcccagctctgcggcccagggggtgacgtgatggcggcagcggtgctgacggaccgggcccaggtgtctgtgacctttgatgatgtggctgtgactttcaccaaggaggagtgggggcagctggacctagctcagcggaccctgtaccaggaggtgatgctggaaaactgtgggctcctggtgtctctgggcgacaaaggaaaacctaagaccacagaacctaccacttgtgagccagccttgtcagagggaatctcacttcagggacaagtgacacaaggaaactcagtggactcacagttggggcaagccgaggatca

SEQ ID NO: 201942 - DNA, 774 bp, Homo sapiens
  Payload ID: 19838
  Gene Name: zinc finger protein 264
  ENST ID: ENST00000600531
  CDS Start-End: 414-668
ttttcttctgcacttctgtctggagaggtctgtagccactgagggccccggtcggggccgctttgcaggtccctagtcaggaccgagcaggggagtaggataggaatccccgccgcacctttgtacgagcctgaccccttccgtgggtttgttcctgggtcgccgtcaagctgcggtctctcctcccccgcccttcagccccgcggtctccaggggcggcgccctgggtctggaacgcggttgccaccgaggaggcggcggccctgcgtctggaacgccgttgccaccgaggaggcggcggccccgagcgcgcctggaagccccgggcaaccggccagggtcgggcacaggtggggtccgtcaggccgcccggggctcctctgtcccagctctgcggcccagggggtgacgtgatggcggcagcggtgctgacggaccgggcccaggtgtctgtgacctttgatgatgtggctgtgactttcaccaaggaggagtgggggcagctggacctagctcagcggaccctgtaccaggaggtgatgctggaaaactgtgggctcctggtgtctctggcacctttacagacacacccaggatcaatacgttgcatccttcaatccaatcaagttgacacattaataaaaatcccagagcacactgagcattgaatactttctctttaaatttaacgactgttactggtgggaagtattattgtattgatccagaaataaaggctcagagaaatgaaatgatgtttttgaggtaacagct

SEQ ID NO: 201943 - DNA, 705 bp, Homo sapiens
  Payload ID: 19838
  Gene Name: zinc finger protein 264
  ENST ID: ENST00000599653
  CDS Start-End: 378-572
cactgagggccccggtcggggccgctttgcaggtccctagtcaggaccgagcaggggagtaggataggaatccccgccgcacctttgtacgagcctgaccccttccgtgggtttgttcctgggtcgccgtcaagctgcggtctctcctcccccgcccttcagccccgcggtctccaggggcggcgccctgggtctggaacgcggttgccaccgaggaggcggcggccctgcgtctggaacgccgttgccaccgaggaggcggcggccccgagcgcgcctggaagccccgggcaaccggccagggtcgggcacaggtggggtccgtcaggccgcccggggctcctctgtcccagctctgcggcccagggggtgacgtgatggcggcagcggtgctgacggaccgggcccaggtgtctgtgacctttgatgatgtggctgtgactttcaccaaggaggagtgggggcagctggacctagctcagcggaccctgtaccaggaggtgatgctggaaaactgtgggctcctggtgtctctgggtaaggccttccttccccctccaccatgcaggtgacctgccacttccttcattccatcttctgactccaggcctggctgcacaagaaggcctctagaatctaccttgcctctttcccacagctttagtcattttccacagtaacctcttcctatctggtctcctatat

SEQ ID NO: 201944 - DNA, 4401 bp, Homo sapiens
  Payload ID: 19839
  Gene Name: zinc finger protein 266
  Uniprot ID: Q14584
  ENST ID: ENST00000592904
  CDS Start-End: 2078-3727
gtttcactctgttgccaggctggagtgccgtggtgtgatctcggctcactgcaacctctgtctctcaggttcaagcgattctcctgcctcagcctcctcagtagctgggatttataggcatgcactaccatgcccagctaatttttgtgttttcagtagagatggggtttcaccacattgcccaggctggtcttgaactcctgacctcaactgacacacctgccttggtttcccaaagtgctgggattacaggcgtgagccaccgcccccggcctgattttttctttatcaaataggggtcattggtatctactgtaaagggtggttatgataattaagcgagtatataaagctgctagtgtgacttctgacacacactgttcctcagtagtggaagttggtcttcctactatttgtagtgtacaccgttttcagtgtcttttcctctatatgctctgcagagagagtgctaatgatgtctgatgactgataagtaatgcttgttgattaatgatttatacaaacaggataccgttaaccctggataaagagaatggaggttacctctgtccgtgtagattcctaagctgtcctggagtgatccttggagtaaaggaaaggtgctttgaagcacattcagccatcagccctgtgggatggcagccactgatttgtcctatggtaagtcctgtttctgttcattttcagataccctgctttaggtgtccccccccacacagtatggagtccagtggcctgtgcctgatcattcacgctgcagcttcatttctgaggtgctgatgtgggctagggaatgctttgttcctttttttttttttttttttgagacagagtcttgctctgttgctcaggctggagtgcagtggcatgatctcagctcattgccacctctgccccccaggttcaagcgattttcctgcctcagcctcccgagtagctgggattacaggcgtgtgccaccacacctggctaattttttgtaattttagtagagatggagtttcaccatgttggccaggatggtctcgaactcctaacctcaagtgatctgcctgcctcgacctcccaaagtgctaggattacaggtgtgagccatcacgcccagccagaatacttcatcagccccctgctgtgtgtgctttgggaagaggtgctgtgtctttccagggaagagaagttttccttatctgtaaaataagactgttacccttttcccagtgggcagcatggctgactatccttttttttgcctttacgtgaggcagtagtgccctggaattgatagcggtggtgtgtatgtgtgtgttttcttgagtgtgcgggagtatataggaatctcacagtaggatggaatgactttggggtacgtgaatgtgggaattatcgtcagccctgggttctcatgccttctttcttttccatgaggtctttacagggacccagtctgccttcaagaaaagacagaagtagaaagggtggtggctgactgtctgacaaattgttatcaggtatgcaggaagtatatccttctccaaaatatcatacttgcatcaccaggtagacacatttccttctacacagaattatcttcagagcttcttaaagcaaataaagcctccttcaaggactgagtccctagtcgaattcccggaaggagtggagcctgtcatattggtgagggtttgccttgaatgtcatcccagtatttcaatattgattaattagtcttccctcatggtcccaactgcatagtttttattttgttgagtgttctgacacatggtaagggacatgaaagtatcctttgagataatctttccattcatcagtgtttatctagcatctgctcaagagtgtgctgcagtggagggaaatcagatgacctcccagtctggttgtgttacatacaatcatgtgtaagaagtgccattcaagccgtgtcactggaggggactgacagtgagattcagtgacttttgatgatctggctgtggacttcaccccagaagaatggactttactggacccaactcagagaaacctctacagagatgtgatgctggagaactacaagaatttggccacagtaggatatcagctcttcaaacccagtctgatctcttggctggaacaagaagagtctaggacagtgcagagaggtgatttccaagcttcagaatggaaagtgcaacttaaaaccaaagagttagcccttcagcaggatgttttgggggagccaacctccagtgggattcaaatgataggaagccacaacggaggggaggtcagtgatgttaagcaatgtggagatgtctccagtgaacactcatgccttaagacacatgtgagaactcaaaatagtgagaacacatttgagtgttatctgtatggagtagacttccttactctgcacaagaaaacctctactggagagcaacgttctgtatttagtcagtgtggaaaagccttcagcctgaacccagatgttgtttgccagagaacgtgcacaggagagaaagcttttgattgcagtgactctgggaaatccttcattaatcattcacaccttcagggacatttaagaactcacaatggagaaagtctccatgaatggaaggaatgtgggagaggctttattcactccacagaccttgctgtgcgtatacaaactcacaggtcagaaaaaccctacaaatgtaaggaatgtggaaaaggatttagatattctgcataccttaatattcacatgggaacccacactggagacaatccctatgagtgtaaggagtgtgggaaagccttcaccaggtcttgtcaacttactcagcacagaaaaactcacactggagagaaaccttataaatgtaaggattgtgggagagccttcactgtttcctcttgcttaagtcaacatatgaaaatccatgtgggtgagaagccttatgaatgcaaggaatgtgggatagccttcactagatcttctcaacttactgaacatttaaaaactcacactgcaaaggatccctttgaatgtaagatatgtggaaaatcctttagaaattcctcatgcctcagtgatcactttcgaattcacactggaataaaaccctataaatgtaaggattgtgggaaagccttcactcagaactcagaccttactaagcatgcacgaactcacagtggagagaggccctatgaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcttttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaactcactggggagaaaccctatgaatgtaaaaatgtggaagcaactttgtatctcaggtcttaatgaacacatatgaattcacagtggagaagaccctgcatcagggaatgtggaaatgactttgctgaattctcaagccttaccaaacacatcagaaatctcactggagagaaactgtatgaatgtagagaatctgggaatacctttctgaatcccacaaaccttaatgtgtgtatgtgaactcacattggagagaaaccctgcaatttaaatggtatggtctggatgatgccccactccatatttgtaagccctaagtcctagttccttacactataactgtatttggacatagggttttcaaacaggtgagtaacttcaaatgaggttgttgggttcgatccctaatctgacatcactggtgtccctataagggaaactgaaggaaggatacacatggagaagactgtgtggatccaccagaagatggccatctacaagccaaggacagagacctggaacagatgctttcattatggcctccagaggaaaccaaccctgtctccaccttgatattgcacttccaggctccagaactgtgaggcaataaatttctcttggtt

SEQ ID NO: 201945 - DNA, 3293 bp, Homo sapiens
  Payload ID: 19839
  Gene Name: zinc finger protein 266
  Uniprot ID: Q14584
  ENST ID: ENST00000588933
  CDS Start-End: 967-2616
ggagccgtttcgggatctgtcaaacaacgagttttcgtcgttcgaatcaggttgactggtccttcatccccccaatctcccgtacctggcgagtccagctcgtcgcggcctgtacctccccacagagcttcaaaacgggcttttaggaagaaggaatggaggctttgaagcaatgctaagaaaagagtgatatgcaagctgagaccaaaaatatggtatgatttagccatactgaaggggaaggaaataagagctgggcaaagcattctgtgaattggctgactccacttctatggtgagagagaggagtgcatcaaagattactcccaggtttgacagagataccgttaaccctggataaagagaatggaggttacctctgtccgtgtagattcctaagctgtcctggagtgatccttggagtaaaggaaaggtgctttgaagcacattcagccatcagccctgtgggatggcagccactgatttgtcctatggtctttacagggacccagtctgccttcaagaaaagacagaagtagaaagggtggtggctgactgtctgacaaattgttatcaggtatgcaggaagtatatccttctccaaaatatcatacttgcatcaccaggtagacacatttccttctacacagaattatcttcagagcttcttaaagcaaataaagcctccttcaaggactgagtccctagtcgaattcccggaaggagtggagcctgtcatattgtgtttatctagcatctgctcaagagtgtgctgcagtggagggaaatcagatgacctcccagtctggttgtgttacatacaatcatgtgtaagaagtgccattcaagccgtgtcactggaggggactgacagattcagtgacttttgatgatctggctgtggacttcaccccagaagaatggactttactggacccaactcagagaaacctctacagagatgtgatgctggagaactacaagaatttggccacagtaggatatcagctcttcaaacccagtctgatctcttggctggaacaagaagagtctaggacagtgcagagaggtgatttccaagcttcagaatggaaagtgcaacttaaaaccaaagagttagcccttcagcaggatgttttgggggagccaacctccagtgggattcaaatgataggaagccacaacggaggggaggtcagtgatgttaagcaatgtggagatgtctccagtgaacactcatgccttaagacacatgtgagaactcaaaatagtgagaacacatttgagtgttatctgtatggagtagacttccttactctgcacaagaaaacctctactggagagcaacgttctgtatttagtcagtgtggaaaagccttcagcctgaacccagatgttgtttgccagagaacgtgcacaggagagaaagcttttgattgcagtgactctgggaaatccttcattaatcattcacaccttcagggacatttaagaactcacaatggagaaagtctccatgaatggaaggaatgtgggagaggctttattcactccacagaccttgctgtgcgtatacaaactcacaggtcagaaaaaccctacaaatgtaaggaatgtggaaaaggatttagatattctgcataccttaatattcacatgggaacccacactggagacaatccctatgagtgtaaggagtgtgggaaagccttcaccaggtcttgtcaacttactcagcacagaaaaactcacactggagagaaaccttataaatgtaaggattgtgggagagccttcactgtttcctcttgcttaagtcaacatatgaaaatccatgtgggtgagaagccttatgaatgcaaggaatgtgggatagccttcactagatcttctcaacttactgaacatttaaaaactcacactgcaaaggatccctttgaatgtaagatatgtggaaaatcctttagaaattcctcatgcctcagtgatcactttcgaattcacactggaataaaaccctataaatgtaaggattgtgggaaagccttcactcagaactcagaccttactaagcatgcacgaactcacagtggagagaggccctatgaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcttttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaactcactggggagaaaccctatgaatgtaaaaatgtggaagcaactttgtatctcaggtcttaatgaacacatatgaattcacagtggagaagaccctgcatcagggaatgtggaaatgactttgctgaattctcaagccttaccaaacacatcagaaatctcactggagagaaactgtatgaatgtagagaatctgggaatacctttctgaatcccacaaaccttaatgtgtgtatgtgaactcacattggagagaaaccctgcaatttaaatggtatggtctggatgatgccccactccatatttgtaagccctaagtcctagttccttacactataactgtatttggacatagggttttcaaacaggtgagtaacttcaaatgaggttgttgggttcgatccctaatctgacatcactggtgtccctataagggaaactgaaggaaggatacacatggagaagactgtgtggatccaccagaagatggccatctacaagccaaggacagagacctggaacagatgctttcattatggcctccagaggaaaccaaccctgtctccaccttgatattgcacttccaggctccagaactgtgaggcaataaatttctcttggttaaa

SEQ ID NO: 201946 - DNA, 3317 bp, Homo sapiens
  Payload ID: 19839
  Gene Name: zinc finger protein 266
  Uniprot ID: Q14584
  ENST ID: ENST00000590306
  CDS Start-End: 997-2646
aaacaacgagttttcgtcgttcgaatcaggttgactggtccttcatccccccaatctcccgtacctggcgagtccagctcgtcgcggcaatgctaagaaaagagtgatatgcaagctgagaccaaaaatatggtatgatttagccatactgaaggggaaggaaataagagctgggcaaagcattctgtgaattggctgactccacttctatggtgagagagaggagtgcatcaaagattactcccagtagagatggtttcagcatgttggccagtctggtctcagactcctgacctcaagtgatccacccacctcggcctcccaaaatgctgggattacaggtataagccactgtgcctggccaaagataccgttaaccctggataaagagaatggaggttacctctgtccgtgtagattcctaagctgtcctggagtgatccttggagtaaaggaaaggtgctttgaagcacattcagccatcagccctgtgggatggcagccactgatttgtcctatggtctttacagggacccagtctgccttcaagaaaagacagaagtagaaagggtggtggctgactgtctgacaaattgttatcaggtatgcaggaagtatatccttctccaaaatatcatacttgcatcaccaggtagacacatttccttctacacagaattatcttcagagcttcttaaagcaaataaagcctccttcaaggactgagtccctagtcgaattcccggaaggagtggagcctgtcatattgtgtttatctagcatctgctcaagagtgtgctgcagtggagggaaatcagatgacctcccagtctggttgtgttacatacaatcatgtgtaagaagtgccattcaagccgtgtcactggaggggactgacagtgagattcagtgacttttgatgatctggctgtggacttcaccccagaagaatggactttactggacccaactcagagaaacctctacagagatgtgatgctggagaactacaagaatttggccacagtaggatatcagctcttcaaacccagtctgatctcttggctggaacaagaagagtctaggacagtgcagagaggtgatttccaagcttcagaatggaaagtgcaacttaaaaccaaagagttagcccttcagcaggatgttttgggggagccaacctccagtgggattcaaatgataggaagccacaacggaggggaggtcagtgatgttaagcaatgtggagatgtctccagtgaacactcatgccttaagacacatgtgagaactcaaaatagtgagaacacatttgagtgttatctgtatggagtagacttccttactctgcacaagaaaacctctactggagagcaacgttctgtatttagtcagtgtggaaaagccttcagcctgaacccagatgttgtttgccagagaacgtgcacaggagagaaagcttttgattgcagtgactctgggaaatccttcattaatcattcacaccttcagggacatttaagaactcacaatggagaaagtctccatgaatggaaggaatgtgggagaggctttattcactccacagaccttgctgtgcgtatacaaactcacaggtcagaaaaaccctacaaatgtaaggaatgtggaaaaggatttagatattctgcataccttaatattcacatgggaacccacactggagacaatccctatgagtgtaaggagtgtgggaaagccttcaccaggtcttgtcaacttactcagcacagaaaaactcacactggagagaaaccttataaatgtaaggattgtgggagagccttcactgtttcctcttgcttaagtcaacatatgaaaatccatgtgggtgagaagccttatgaatgcaaggaatgtgggatagccttcactagatcttctcaacttactgaacatttaaaaactcacactgcaaaggatccctttgaatgtaagatatgtggaaaatcctttagaaattcctcatgcctcagtgatcactttcgaattcacactggaataaaaccctataaatgtaaggattgtgggaaagccttcactcagaactcagaccttactaagcatgcacgaactcacagtggagagaggccctatgaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcttttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaactcactggggagaaaccctatgaatgtaaaaatgtggaagcaactttgtatctcaggtcttaatgaacacatatgaattcacagtggagaagaccctgcatcagggaatgtggaaatgactttgctgaattctcaagccttaccaaacacatcagaaatctcactggagagaaactgtatgaatgtagagaatctgggaatacctttctgaatcccacaaaccttaatgtgtgtatgtgaactcacattggagagaaaccctgcaatttaaatggtatggtctggatgatgccccactccatatttgtaagccctaagtcctagttccttacactataactgtatttggacatagggttttcaaacaggtgagtaacttcaaatgaggttgttgggttcgatccctaatctgacatcactggtgtccctataagggaaactgaaggaaggatacacatggagaagactgtgtggatccaccagaagatggccatctacaagccaaggacagagacctggaacagatgctttcattatggcctccagaggaaaccaaccctgtctccaccttgatattgcacttccaggctccagaactgtgaggcaataaatttctcttg

SEQ ID NO: 201947 - DNA, 3100 bp, Homo sapiens
  Payload ID: 19839
  Gene Name: zinc finger protein 266
  Uniprot ID: Q14584
  ENST ID: ENST00000592292
  CDS Start-End: 804-2453
cagctttggcgaggtcggatgacgggtgggagccagcggtggaaggggtggcgaaagtaccggtttgccccaggccgccgaggggcctccttagagagaccttgcctgctccgctcgcgtccgccggggccgcgcgggtcctcctggcgccgccaggttcaaaaagccactcgagttgtcactgcgacggccctgggccaggagccgtttcgggatctgtcaaacaacgagttttcgtcgttcgaatcaggttgactggtccttcatccccccaatctcccgtacctggcgagtccagctcgtcgcggataccgttaaccctggataaagagaatggaggttacctctgtccgtgtagattcctaagctgtcctggagtgatccttggagtaaaggaaaggtgctttgaagcacattcagccatcagccctgtgggatggcagccactgatttgtcctatggtctttacagggacccagtctgccttcaagaaaagacagaagtagaaagggtggtggctgactgtctgacaaattgttatcaggtatgcaggaagtatatccttctccaaaatatcatacttgcatcaccaggtagacacatttccttctacacagaattatcttcagagcttcttaaagcaaataaagcctccttcaaggactgagtccctagtcgaattcccggaaggagtggagcctgtcatattggattcagtgacttttgatgatctggctgtggacttcaccccagaagaatggactttactggacccaactcagagaaacctctacagagatgtgatgctggagaactacaagaatttggccacagtaggatatcagctcttcaaacccagtctgatctcttggctggaacaagaagagtctaggacagtgcagagaggtgatttccaagcttcagaatggaaagtgcaacttaaaaccaaagagttagcccttcagcaggatgttttgggggagccaacctccagtgggattcaaatgataggaagccacaacggaggggaggtcagtgatgttaagcaatgtggagatgtctccagtgaacactcatgccttaagacacatgtgagaactcaaaatagtgagaacacatttgagtgttatctgtatggagtagacttccttactctgcacaagaaaacctctactggagagcaacgttctgtatttagtcagtgtggaaaagccttcagcctgaacccagatgttgtttgccagagaacgtgcacaggagagaaagcttttgattgcagtgactctgggaaatccttcattaatcattcacaccttcagggacatttaagaactcacaatggagaaagtctccatgaatggaaggaatgtgggagaggctttattcactccacagaccttgctgtgcgtatacaaactcacaggtcagaaaaaccctacaaatgtaaggaatgtggaaaaggatttagatattctgcataccttaatattcacatgggaacccacactggagacaatccctatgagtgtaaggagtgtgggaaagccttcaccaggtcttgtcaacttactcagcacagaaaaactcacactggagagaaaccttataaatgtaaggattgtgggagagccttcactgtttcctcttgcttaagtcaacatatgaaaatccatgtgggtgagaagccttatgaatgcaaggaatgtgggatagccttcactagatcttctcaacttactgaacatttaaaaactcacactgcaaaggatccctttgaatgtaagatatgtggaaaatcctttagaaattcctcatgcctcagtgatcactttcgaattcacactggaataaaaccctataaatgtaaggattgtgggaaagccttcactcagaactcagaccttactaagcatgcacgaactcacagtggagagaggccctatgaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcttttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaactcactggggagaaaccctatgaatgtaaaaatgtggaagcaactttgtatctcaggtcttaatgaacacatatgaattcacagtggagaagaccctgcatcagggaatgtggaaatgactttgctgaattctcaagccttaccaaacacatcagaaatctcactggagagaaactgtatgaatgtagagaatctgggaatacctttctgaatcccacaaaccttaatgtgtgtatgtgaactcacattggagagaaaccctgcaatttaaatggtatggtctggatgatgccccactccatatttgtaagccctaagtcctagttccttacactataactgtatttggacatagggttttcaaacaggtgagtaacttcaaatgaggttgttgggttcgatccctaatctgacatcactggtgtccctataagggaaactgaaggaaggatacacatggagaagactgtgtggatccaccagaagatggccatctacaagccaaggacagagacctggaacagatgctttcattatggcctccagaggaaaccaaccctgtctccaccttgatattgcacttccaggctccagaa

SEQ ID NO: 201948 - DNA, 760 bp, Homo sapiens
  Payload ID: 19839
  Gene Name: zinc finger protein 266
  ENST ID: ENST00000591213
  CDS Start-End: 544-760
attcccggaaggagtggagcctgtcatattggtgagggtttgccttgaatgtcatcccagtatttcaatattgattaattagtcttccctcatggtcccaactgcatagtttttattttgttgagtgttctgacacatggtaagggacatgaaagtatcctttgagataatctttccattcatcagtgtttatctagcatctgctcaagagtgtgctgcagtggagggaaatcagatgacctcccagtctggttgtgttacatacaatcatgtgtaagaagtgccattcaagccgtgtcactggaggggactgacagtgagtgagtgtggatagagaggacctcctggggtgggcaatgtgagccctcagactctgtaggtattgcattttgcagtgaacactggtagacatgttttgtggctcaagccagcatgtgtgtgatggtttaggattcagtgacttttgatgatctggctgtggacttcaccccagaagaatggactttactggacccaactcagagaaacctctacagagatgtgatgctggagaactacaagaatttggccacagtaggatatcagctcttcaaacccagtctgatctcttggctggaacaagaagagtctaggacagtgcagagaggtgatttccaagcttcagaatggaaagtgcaacttaaaaccaaagagttagcccttcagcaggatgttttgggggagccaacctccagtgggattcaaatgataggaagccaca

SEQ ID NO: 201949 - DNA, 3503 bp, Homo sapiens
  Payload ID: 19839
  Gene Name: zinc finger protein 266
  Uniprot ID: Q14584
  ENST ID: ENST00000588221
  CDS Start-End: 1177-2826
ctggtggcgtttgggcttaatacagctttggcgaggtcggatgacgggtgggagccagcggtggaaggggtggcgaaagtaccggtttgccccaggccgccgaggggcctccttagagagaccttgcctgctccgctcgcgtccgccggggccgcgcgggtcctcctggcgccgccaggttcaaaaagccactcgagttgtcactgcgacggccctgggccaggagccgtttcgggatctgtcaaacaacgagttttcgtcgttcgaatcaggttgactggtccttcatccccccaatctcccgtacctggcgagtccagctcgtcgcggcctgtacctccccacagagcttcaaaacgggcttttaggaagaaggaatggaggctttgaagataccgttaaccctggataaagagaatggaggttacctctgtccgtgtagattcctaagctgtcctggagtgatccttggagtaaaggaaaggtgctttgaagcacattcagccatcagccctgtgggatggcagccactgatttgtcctatggtctttacagggacccagtctgccttcaagaaaagacagaagtagaaagggtggtggctgactgtctgacaaattgttatcaggtatgcaggaagtatatccttctccaaaatatcatacttgcatcaccaggtagacacatttccttctacacagaattatcttcagagcttcttaaagcaaataaagcctccttcaaggactgagtccctagtcgaattcccggaaggagtggagcctgtcatattggtgagggtttgccttgaatgtcatcccagtatttcaatattgattaattagtcttccctcatggtcccaactgcatagtttttattttgttgagtgttctgacacatggtaagggacatgaaagtatcctttgagataatctttccattcatcagtgtttatctagcatctgctcaagagtgtgctgcagtggagggaaatcagatgacctcccagtctggttgtgttacatacaatcatgtgtaagaagtgccattcaagccgtgtcactggaggggactgacagtgagattcagtgacttttgatgatctggctgtggacttcaccccagaagaatggactttactggacccaactcagagaaacctctacagagatgtgatgctggagaactacaagaatttggccacagtaggatatcagctcttcaaacccagtctgatctcttggctggaacaagaagagtctaggacagtgcagagaggtgatttccaagcttcagaatggaaagtgcaacttaaaaccaaagagttagcccttcagcaggatgttttgggggagccaacctccagtgggattcaaatgataggaagccacaacggaggggaggtcagtgatgttaagcaatgtggagatgtctccagtgaacactcatgccttaagacacatgtgagaactcaaaatagtgagaacacatttgagtgttatctgtatggagtagacttccttactctgcacaagaaaacctctactggagagcaacgttctgtatttagtcagtgtggaaaagccttcagcctgaacccagatgttgtttgccagagaacgtgcacaggagagaaagcttttgattgcagtgactctgggaaatccttcattaatcattcacaccttcagggacatttaagaactcacaatggagaaagtctccatgaatggaaggaatgtgggagaggctttattcactccacagaccttgctgtgcgtatacaaactcacaggtcagaaaaaccctacaaatgtaaggaatgtggaaaaggatttagatattctgcataccttaatattcacatgggaacccacactggagacaatccctatgagtgtaaggagtgtgggaaagccttcaccaggtcttgtcaacttactcagcacagaaaaactcacactggagagaaaccttataaatgtaaggattgtgggagagccttcactgtttcctcttgcttaagtcaacatatgaaaatccatgtgggtgagaagccttatgaatgcaaggaatgtgggatagccttcactagatcttctcaacttactgaacatttaaaaactcacactgcaaaggatccctttgaatgtaagatatgtggaaaatcctttagaaattcctcatgcctcagtgatcactttcgaattcacactggaataaaaccctataaatgtaaggattgtgggaaagccttcactcagaactcagaccttactaagcatgcacgaactcacagtggagagaggccctatgaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcttttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaactcactggggagaaaccctatgaatgtaaaaatgtggaagcaactttgtatctcaggtcttaatgaacacatatgaattcacagtggagaagaccctgcatcagggaatgtggaaatgactttgctgaattctcaagccttaccaaacacatcagaaatctcactggagagaaactgtatgaatgtagagaatctgggaatacctttctgaatcccacaaaccttaatgtgtgtatgtgaactcacattggagagaaaccctgcaatttaaatggtatggtctggatgatgccccactccatatttgtaagccctaagtcctagttccttacactataactgtatttggacatagggttttcaaacaggtgagtaacttcaaatgaggttgttgggttcgatccctaatctgacatcactggtgtccctataagggaaactgaaggaaggatacacatggagaagactgtgtggatccaccagaagatggccatctacaagccaaggacagagacctggaacagatgctttcattatggcctccagaggaaaccaaccctgtctccaccttgatattgcacttccaggctccagaactgtgaggcaataaatttctcttggttaaa

SEQ ID NO: 201950 - DNA, 3317 bp, Homo sapiens
  Payload ID: 19840
  Gene Name: zinc finger protein 267
  Uniprot ID: Q14586
  ENST ID: ENST00000300870
  CDS Start-End: 210-2441
ggagagcaggggcggcttccgggatttggcgggggccttcgtcggctccagttagagctcgggtctcctcgccacagctccgagtctttcgttctgggaggcccaggcggcttcgcgttctgagaataaacagaacctctgttgctctgcgacttgcaggcactgggagattcgtagctaagacgccagggcatcccggaagctgggaaatgggactgttgacattcagggatgtggccgtagaattctctttggaggagtgggaacacctggaaccagctcagaagaatttgtatcaggatgtgatgttagaaaactacagaaacctggtctctctgggtcttgttgtctctaagccggacctgatcacctttttggaacaaaggaaagagccttggaatgtgaagagtgaggagacagtagccatccagccagatgtgttttcgcattataacaaggacctgttgacagagcactgcacagaagcttcattccaaaaagtgatatcgaggagacatgggagctgtgatcttgagaatttacatttaagaaaaaggtggaaaagggaggagtgtgaagggcacaatggatgttatgatgaaaagacttttaaatatgatcaatttgatgaatcctctgttgaaagtttgtttcaccagcaaatactttcttcttgtgccaaaagctataactttgatcaatataggaaggtctttactcattcatcattgcttaatcaacaagaggaaatagatatttggggaaaacatcacatatatgataaaacttcagtgttatttaggcaggtctctactctaaatagttaccgaaatgtttttattggagagaaaaattatcattgcaataattctgaaaaaaccttgaaccaaagctcaagccctaaaaatcatcaggaaaattattttctagaaaaacaatacaaatgtaaagaatttgaggaagtctttcttcagagtatgcatgggcaagagaaacaagaacagtcttacaaatgtaataaatgtgtagaagtttgtacccagtcattaaaacatattcaacatcagaccatccatatcagagaaaactcatatagctataacaaatatgataaagatcttagtcagtcatcaaatcttagaaagcagataatccataatgaagagaaaccatacaaatgtgaaaaatgtggggatagcttaaaccatagtttgcaccttactcaacatcagatcattcctaccgaagagaaaccctgtaaatggaaagaatgtggcaaggtctttaaccttaactgtagtttataccttactaaacagcagcaaattgatactggagaaaacctttacaaatgtaaagcatgtagcaaatcttttactcgttcctccaatcttattgtgcatcagagaattcacactggagagaaaccatacaaatgtaaagaatgtggcaaagcctttcgctgtagttcataccttactaaacataagcgaattcatactggagagaaaccttataaatgtaaagaatgtggaaaagcttttaaccgtagttcatgccttactcaacatcagacaactcatacaggagaaaaactttacaaatgtaaagtatgtagcaaatcttatgctcgttcttcaaatcttattatgcatcagagagttcatactggagagaagccttataaatgtaaagaatgtggcaaagtctttagccgtagttcttgccttactcaacatcggaaaattcatactggagaaaatctttacaaatgcaaagtatgtgctaaaccttttacttgtttctcaaatcttattgtgcatgagagaattcatactggagagaaaccctataaatgtaaagaatgtggcaaagcctttccttatagttcacaccttattcgacatcatcgaattcatactggagaaaaaccatacaaatgtaaagcatgtagcaaatcttttagtgactcctcaggtcttactgtgcatcggcgaactcatactggagagaaaccctatacatgtaaagaatgtggcaaagcctttagttatagttcagatgttattcagcatcggagaattcatactggccagagaccctacaaatgtgaagaatgtggcaaagccttcaactataggtcatacctcactacacatcagagaagtcatactggagagagaccctacaaatgtgaagaatgtggcaaagccttcaactctaggtcatacctcactacacatcggagaagacatactggagagagaccctacaaatgtgatgaatgtggtaaagccttcagctataggtcatacctcactacacatcggagaagtcatagtggagagagaccctacaaatgtgaagaatgtggcaaagcctttaactctaggtcatacctcattgcacatcagagaagtcatactagagaaaaactttaaaaatgtaaaacatggagcagattttttacttgttacccatgtcttattgtgcatcagataatttatatgggagtgaaaccctacaaatgttaagaatgtggcataacctttaactattttcaagccttacacaatagcagagaatataaactgaaaaaatccatacaaatattaaaaatgtggcaaattattttaaactgtgctcaacccttactcaagataatccatactagagaaacactatagatgtaaaaatgtgaaaagttttattcaaaatatcaaacttatgagtcacctaggggttcatagaaaaaggaagtttgcagatgcaataaatgtgaggaagtatttaataaaaaatgaagtctaaatgtgtcagagaatttatgtgagaaaggactaaagcacagacactttcagcctttatactaaataagagtattttttgtacagaataatctaaaggcaaaataattagataatttatttgcttatatgttttaaagtagcaagaacattgatgttttgacaggtatatttcatagatacttcatttgtatttacagtatttgaggtttttggaaagcaaatattatttatataattcagctttcaaatctgttgctgcttttccttaatccgtggtgttcatgtgaaaatatgtgttctgtttttttttctgcatcagaacaatgtgaggtcattctacgttaatatcattaatatcagcatttttcatggaagtttaatgccaaatgtaaaacacatgaaaatttttaaaaatatgctctttgtgtttgaataaagtagtaatgcatgtaaacatatacgtgtttagagctcttttctatattaaagtaagagggatattctgaa

SEQ ID NO: 201951 - DNA, 563 bp, Homo sapiens
  Payload ID: 19840
  Gene Name: zinc finger protein 267
  ENST ID: ENST00000561814
  CDS Start-End: 1-149
agctccgagtctttcgttctgggaggcccaggcggcttcgcgttctgagaataaacagaacctctgttgctctgcgacttgcaggcactgggagattcgtagctaagacgccagggcatcccggaagctgggaaatgggccctgtatagccaccctctatccagtcttttcctgttcctgaatttcagaactgtctgggatgactcaagatgcccacagtggccatgtctcctggagtgtttagtgactgtcagccccaggtcacctcctgttagaggaccgcccaagggactgttgacattcagggatgtggccgtagaattctctttggaggagtgggaacacctggaaccagctcagaagaatttgtatcaggatgtgatgttagaaaactacagaaacctggtctctctgggtcttgttgtctctaagccggacctgatcacctttttggaacaaaggaaagagccttggaatgtgaagagtgaggagacagtagccatccagccagatgtgttttcgcattataacaaggacctgttgacagagcactgcacagaagc

SEQ ID NO: 201952 - DNA, 589 bp, Homo sapiens
  Payload ID: 19840
  Gene Name: zinc finger protein 267
  ENST ID: ENST00000566541
  CDS Start-End: 1-154
acagctccgagtctttcgttctgggaggcccaggcggcttcgcgttctgagaataaacagaacctctgttgctctgcgacttgcaggcactgggagattcgtagctaagacgccagggcatcccggaagctgggaaatgaactgtctgggatgactcaagatgcccacagtggccatgtctcctggagtgtttagtgactgtcagccccaggtcacctcctgttagaggaccgcccaagggactgttgacattcagggatgtggccgtagaattctctttggaggagtgggaacacctggaaccagctcagaagaatttgtatcaggatgtgatgttagaaaactacagaaacctggtctctctgggtcttgttgtctctaagccggacctgatcacctttttggaacaaaggaaagagccttggaatgtgaagagtgaggagacagtagccatccagccaggacattgaagttccctgttattgcatttcgttttctcaccacagatgtgttttcgcattataacaaggacctgttgacagagcactgcacagaagcttcattccaaaaagtgatatcgaggagacat

SEQ ID NO: 201953 - DNA, 567 bp, Homo sapiens
  Payload ID: 19840
  Gene Name: zinc finger protein 267
  ENST ID: ENST00000562971
  CDS Start-End: 293-567
agcctcggggtctgggccccgagtcccaactggtgcagctcggccctcggtcccctccgctgcaagatggcggccaggccggcagccgggaccccgcgtgtcctgtcccatcccgaccccgcagagcgacctcgtccctggccggagccctctctgggcagctccgcgtcgcagccccgcgtctcccccagattgtgcgggactgttgacattcagggatgtggccgtagaattctctttggaggagtgggaacacctggaaccagctcagaagaatttgtatcaggatgtgatgttagaaaactacagaaacctggtctctctgggtcttgttgtctctaagccggacctgatcacctttttggaacaaaggaaagagccttggaatgtgaagagtgaggagacagtagccatccagccagatgtgttttcgcattataacaaggacctgttgacagagcactgcacagaagcttcattccaaaaagtgatatcgaggagacatgggagctgtgatcttgagaatttacatttaagaaaaaggtggaaaagggaggagtgtgaagg

SEQ ID NO: 201954 - DNA, 680 bp, Homo sapiens
  Payload ID: 19840
  Gene Name: zinc finger protein 267
  ENST ID: ENST00000394846
  CDS Start-End: 161-394
agttagagctcgggtctcctcgccacagctccgagtctttcgttctgggaggcccaggcggcttcgcgttctgagaataaacagaacctctgttgctctgcgacttgcaggcactgggagattcgtagctaagacgccagggcatcccggaagctgggaaatgggactgttgacattcagggatgtggccgtagaattctctttggaggagtgggaacacctggaaccagctcagaagaatttgtatcaggatgtgatgttagaaaactacagaaacctggtctctctgggtcttgttgtctctaagccggacctgatcacctttttggaacaaaggaaagagccttggaatgtgaagagtgaggagacagtagccatccagccaggacattgaagttccctgttattgcatttcgttttctcaccacagatgtgttttcgcattataacaaggacctgttgacagagcactgcacagaagcttcattccaaaaagtgatatcgaggagacatgggagctgtgatcttgagaatttacatttaagaaaaaggtggaaaagggaggagtgtgaagggcacaatggatgttatgatgaaaagacttttaaatatgatcaatttgatgaatcctctgttgaaagtttgtttcaccagcaaatactttcttcttgtgccaaaag

SEQ ID NO: 201955 - DNA, 3543 bp, Homo sapiens
  Payload ID: 19841
  Gene Name: zinc finger protein 268
  Uniprot ID: Q14587
  ENST ID: ENST00000228289
  CDS Start-End: 207-3050
atgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggctgcagatctggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaaacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaaaataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctataaggg

SEQ ID NO: 201956 - DNA, 897 bp, Homo sapiens
  Payload ID: 19841
  Gene Name: zinc finger protein 268
  ENST ID: ENST00000416488
  CDS Start-End: 331-897
ccggcgcgggagtaactcctcgcagaggcctctgggagttgtagtttttttgcctttgcctctccatgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaattttgaaggctggaaagtccaaagccaaggtgctggcaggtttggtgtctggtgagggcctgctctgtgcttccaagatgacgccttgttgctgcatcctctggaggtga

SEQ ID NO: 201957 - DNA, 592 bp, Homo sapiens
  Payload ID: 19841
  Gene Name: zinc finger protein 268
  ENST ID: ENST00000546126
  CDS Start-End: 245-361
atacgtagcggccgccattgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggctggagtgcagtggctatctctgctcaccacaacgtctgcttcccgagttcaagtggttctcttgcctcagcctcctgagtagctgggattacaggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatg

SEQ ID NO: 201958 - DNA, 861 bp, Homo sapiens
  Payload ID: 19841
  Gene Name: zinc finger protein 268
  ENST ID: ENST00000542711
  CDS Start-End: 229-531
attgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttggggtaccaacacaccaaacctgatatcatcttcaagttggaacaaggagaagagctgtgtatggtgcaggcccaagttccaaatcagacctgtccaaacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattg

SEQ ID NO: 201959 - DNA, 3236 bp, Homo sapiens
  Payload ID: 19841
  Gene Name: zinc finger protein 268
  ENST ID: ENST00000536899
  CDS Start-End: 226-432
gttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttggacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaaaataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctataagggaaagtgtaaatctagaaatgagaaacccctagggaaaaaatatatataggagtgaacatcttatgaatgtaccaaataaaccacagctggactgttaa

SEQ ID NO: 201960 - DNA, 3773 bp, Homo sapiens
  Payload ID: 19841
  Gene Name: zinc finger protein 268
  ENST ID: ENST00000541009
  CDS Start-End: 181-762
cgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaattttgaaggctggaaagtccaaagccaaggtgctggcaggtttggtgtctggtgagggcctgctctgtgcttccaagatgacgccttgttgctgcatcctctggagacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaaaataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctataagggaaagtgtaaatctagaaatgagaaacccctagggaaaaaatatatataggagtgaacatcttatgaatgtaccaaataaaccacagctggactgttaacctcaccttagaagcttcattctaaaaaaaaaaaaaaaaaaaaaaaaaaaaa

SEQ ID NO: 201961 - DNA, 781 bp, Homo sapiens
  Payload ID: 19841
  Gene Name: zinc finger protein 268
  ENST ID: ENST00000541211
  CDS Start-End: 245-748
atacgtagcggccgccattgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggtaccaacacaccaaacctgatatcatcttcaagttggaacaaggagaagagctgtgtatggtgcaggcccaagttccaaatcagacctgtccaaacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaa

SEQ ID NO: 201962 - DNA, 3773 bp, Homo sapiens
  Payload ID: 19841
  Gene Name: zinc finger protein 268
  ENST ID: ENST00000542986
  CDS Start-End: 226-762
gttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctgggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaattttgaaggctggaaagtccaaagccaaggtgctggcaggtttggtgtctggtgagggcctgctctgtgcttccaagatgacgccttgttgctgcatcctctggagacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaaaataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctataagggaaagtgtaaatctagaaatgagaaacccctagggaaaaaatatatataggagtgaacatcttatgaatgtaccaaataaaccacagctggactgttaacctcaccttagaagcttcattctaaaaaaaaaaaaaaaaaaaaaaaaaaaaa

SEQ ID NO: 201963 - DNA, 13475 bp, Homo sapiens
  Payload ID: 19841
  Gene Name: zinc finger protein 268
  Uniprot ID: Q14587
  ENST ID: ENST00000536435
  CDS Start-End: 331-3174
ccggcgcgggagtaactcctcgcagaggcctctgggagttgtagtttttttgcctttgcctctccatgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaaacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaaaataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctataagggaaagtgtaaatctagaaatgagaaacccctagggaaaaaatatatataggagtgaacatcttatgaatgtaccaaataaaccacagctggactgttaacctcaccttagaagcttcattctaaaaaaaaaaaaaaaaaaaaaaaaaaaaaccaacctgttattatatcttaatattaattttgaagaattatttcttttaggaatcattttaagaaattttattccaggtgttccaaaatttcaggaaaaggtttgagaaaattctcaattataaataataagatacagattatttcattgtacaagtgaatctagtaaggaggttaagaataagaaataacatcccagagcctacagggatatttagatatcttcctatgtgtactacataatatgaattttgcagtttggcattttacttgcgaatgccatatgtgagacaaaaatcatcttccagagatttcagtatctctgatactgacaatatctctgatatgacaatatcatcttccagagatttctactctgcataccaacattgtttctttgtgtcttaccaaatgcaacttgttactagaatatgacttactaaaaatgcatttccacactgcaaacattttttagggctatcttctgccctttggaagcagtcttggcagcaacctctttagtaatcaatataaggcacacttcatgtgtttgtgtagcctggaatctattctaccttcacaggttagaacatcttgatttcctcttaacgaaacattccctaacggtgtatgtagtcatgagggaaccaccattcaagatgccctgctcaggacttggcatgagcactatggtcagctgaggctcagaactgtacattgttaatgggtttttcaagttcagaaaagcaacatgagcttttgttctgtggtagcatgttgatgtaataagtagctatttcaatagaggttcccagaacagcttttgttactgtcattttcttaactttgttcacttgtcttttattttgagctattgggtgtgcttttaatacattccttgtttgattgcattagccattgtgtatcttttgcatacagcttactaaatcagatggcttcagaaatgggtggtagaggagtaggcagaaacttgcaaggatatgtggatatttggaaatggttgtttcccaagacaggatggaagtcttttaagcaagaaacttggcccatgctatgaagtcatgaaatgaattgttggcatcatgtgctcactgaggctttggggaaatggataagttgtcattgaaaaattttaaacagaattctggagtggtcaagaggggaatgcttttgatacccatgtataacatggagaataatgatcttaaaacttcaatttaagattatgtgtcagtgatactacttagttacatgtagctatagagtcacagtggtgaaaaactctgccagttgcttactcacaaagttagttttcttcactacctcatcaggtttgttatgtgagtgggcattaatctgggaagagtgggaccctgccagttagattagggctatcttggaggaatatgcggattcaatactgcaaatatttctgaaacaccttctgctttgtactctattagatacccaaagaaattttcatccttgaagcggaggaatttaatgatacctgaatgcctaactgttgtattctgcttatacagaatccaatctcaagatacttggggtgaagaatgatgattcacagaagggaagggacatcttacataaacaaataatcgcagatacttgctaaagtgtatcccccaatctgggaaatactgtaaaggtgtatattattattgatgtaccaaagaagacagaataaattcataagagaaagtttatattcagtttactactacctagggttagattttagtttgttgttttttcagatgcaaatctacatgcagccttgcctggtagaagccagaagtgttgacagtattgaggacagcactcacatactgtgggaaagaataatacttgattaggacttattatttaatgaaatgaaaattttacaaaacagaaattgagttactggtttgtaaatctatctagtccttctaccccagccccagaaaagaaagacattccagagacttttcaggaatagttattataaggaaaatccaaggaaaaataaccccaatattttacaacttccccatcaaatagaaatttaggagaaaaaatgacttgcaaaccatatttgtgaacataggtttaaaaatccatatttgtgaacataggtttaaaaatccatatttgtgaacataggtttaaaaattctaaatggaattatagcaaaccaatgtatagctaacaagaaagtcatgatattaggtttaacagactattagtggatccagcatcctttgttcattaccagcagaatcactattatttataatggcagtatgcccacttaaaaagagatatatggggccaggcacggtggctcacacctataatcccagcacttcaggaggctgagatggtggatcacctgaggtcaggagtttgagaccagcctggccaacatggtgaaacccctctctactaaaaatacaaaaaaatagcagggcatggtaactgacacctataatcccagctacttgggaggctgggacgggagaatcacttgaatctaggaggcggaagttgcagtgagctgagatcgtaccactgtactccaccctgggtgacagaactagaccctgtctcaaaaaacagaagagtatgtttggaagatttaatattagaaaatattttaattaactaccagataaaactcataaggattatctcagtatatgctgataaatcacttgatggaatttaacacccatagatgacactaaaatactattaagttgggaattaaaattaactcctgtaacttggtagggaatatatgttctgaaaacacaaatgtcatacttaatgataaaatagtagaaagattcctttaaagtaaaattagccaggtgcagtggctcatccatgtaataccagcacttgggaaggctgaggctggaggattgctggaacccaggagttcgagacaagcctgaccaatatagggagaccctgtctgtacaaaaactttttaaaaagattagccaggtgtggtcaggcgccgtggctcatgcctgtaatcccagcactttgggaggccgaggtgggcagatcacttgaggtcaggatttcaagaccagtgtggctaacatggtgaaaccccgtctctactaaaaatacaaaagtcagccaggtgtggtggcacgtgcctgtaatcccatctactcgggaggctgaggcagaagaattgcttgaacctaggaggtggcagttgcagtgagccaagattgcaccactgcactccaggctgggcgacagaacaagcctccatctcaaaaaaaagatcagccaggtgtagtggcaagtgccggtagtcccacctactgaggaggctgaggcaggaggttagcttgagtccagtagttcaaggctacagtgagctatgatcatgcccctgcactccatcctgggcaacaaagtgagaccctgtctgtaaaaaacaaagcaaaattacaagaatgcgcatcacttttatgaaatgagtaacatctagccaaggtgtgaaaacaaggaatgtgaggaattagggatgggtgcagaaacaactgccatgaattggagatgtgatcgtgtaattaggaaacccaaaataaaccacaaacaaatgtttggaactgccagtagagtagcaagtatgcagttgtcagtattcatggaggacccccccgcaaccacagatactccctgtggatgctcaagctccttatatggcatagtatttgcatttttttttttttttttgagatggagtctcgctgtattgccaggctggagtgcagtggtgtgttcttggctcactgcaacctctgcctcctgggttcaagcaattctcctgcctcagcctccctagtagctggaattacaggcacacgccaccacgcccagctaatttttgtgtttttagtagagatggggtttcaccatgttggccaggctggtcttgaactcctgacctcgtgatccaccctcagcctcccaaagtgctgggattacaggtgtgagccactggtctgtattgatttttcttaattctttgctaaagggccaggtagagttatttatttcttgtagagatggggttttaccatgttttccagtctggtttcaaactcctgggctcaagcagtccacctgccttggcctcccaaagtgctaggattacaggtgtgagccaagcacccagccataaatcttaaataaattctgattttggtataaatgatatatttaaatttaaatgaagttgcaagttttaacatgtctactctttaattttcaacattgtttcaactacttgttagaaacacaggccattaaaacattaataaaaaggctgggcatggtggctcatgcctgtaatctcagcattttgtgaggctgaggcaggtggatgacttgaggtcaggagttcgagaccagcctggtgaaaccccgtctctactaaaaatacaaaaattggccagctgtggtggcatgcatctataatccaagctactcaggagaattgcttgaactggagaggcggaggttgcagtgagctgagattgtgccattgcactccagcccgggcagcagagtgagactccttcaaaaaaaattaataaaagcaagcacatagggtgcacatttgcccttccctcttgggatccagggtgatcccacaggtgctgttcatccccaactttgacctggactgttgcagtgttttgtcgcagtgtttctccctttttttgtactgggatttctccccagaaacaaacccatatgtataaaaagtagttgggcttgctataaagatgactagtggaaacctcaatagaggtacgatttcctaaaataaatcttgttcagatattacagggcaaagtgaaacagcaaagctccctcctcagcactcagggtgcaggcctcacttttcctcatcttttcctcctgtggcctccatgtatcccaaaggtgagatgacatcgccccagattggtccggaaagtgcactggtcgtcactgtgggtgtaccctacaggagtcttcagatatggaagctctggatctcactgtgatgtatccccctagggggtccccaggttgtgaggaaaaggaagctttagtcctcactgtggttgcatcccccaccacgggtcagtcctgaggaggatactctggtcatcactgtgatctacctcccaggggtccccaggttggtcctgaggagaaggaagctcagaacctcactgtggatttgccccactagggtccctaggtcagtcctgaagagaaacaagctccagtcttcactgtggttgtgccccacagtggtcctcaggttggccagtggagaaggaagctctggttctcagtgtgatgcatcccccaggttggtcctgagatgaggtaaattctggtcatcactgtgaagtgccctcgggggtctccgggtcctgagtagaagcaaggtctgtttgtcactgtggattcccccctgccaagggtccccaggtcagtcctgaggagaaggcagctcagtctttactgtgatgcagcctctagtgatccccaggtcctgagtagaaggaaggcctggtcctctgtggattcaacccagaggtctgtgagcagaatgcaggtactgcaagcaggctagacaaggtgtgtgcttgcaccccttccttactacctaggcacagtgttggatggtcagtgcttcctgttttgtgatggccatgtgccccctcttgcagtcccagtgaacccctgaaattcaatcttacgattttccatgccataattttggaaaacgaaactgaaatagagtccatcattccatgccttaattggaatggatagagataataaaaggcaaagtagatggccatagacaaaagtcaagtgatttcctatatatttgaaataatgtatagcaataattggaatttgtaatgaataaaatcattcaaaaaaatctgaaaaagtgtttgtatgcaaaatataaaaaaaaaaccctaaaattgaacaagaagacaacccaattaaaaatggggacagatccaaatacatactttccaaagatatacagatggtggccaggcacggtggctcacgcctgtaatcccagcactttgggaggccgaggcgggcagatcacctgaggtccggagttcgagaccagcctgaccaacatggagaaaccctgtctctactaaaaatacaaaattagccaggcgtggtggcgctactctgccaccaagtggtagctactccggaggcggaggcaggagaatggcttgaacccgggaggcggaggttgctgtgagccgagatcgcgccattgcactccagcctgggcaacaagagtgaaactccgtctcaaaaaaaaaaaaaagaagatatacagatggcaaataagcataccaaataatgctcagtgacacttgtcatgagggaaaagcaaattaaaacaacgagatagcaccgcacatctattaaagtgactataatctaaaaataagtaaatttgcaattgcaacaggaactctcattcattgctggtgcaatgcataatagtatagccactttggaagatagtttgacttttccccaaagctaaacaaagcttcacaatatgagccaacaatcacactcctaggtatttagataactgctttgaaaacataggagtttgatctaaacaaaacccagcatgtactcacgtacagcagctcttttcataacagacaaatactttaaggaatcaggataaccttcaataggtgaatgactaactaggctggggtacatccatgcaatggagtcctgttcagcaagagcaagctctgaggccatgcaggacatggatgaatctgataggcatattgctaagtgaaagagaccagtgtgaaaaggctgtatgatcctatttctatgatgttatggaaaagcagaaactacaggggtagcaaacatatctgtgattgatgacggtttgtagagggcagggagtgagttaaataggaggatataatgatagaaacaggcacaaatgggcctttggagagtgtactccctctgcttggtgaaattatgctgggtgtgtgtggaagagcctgggatgtataatgccagcatgaacaaaaaggccacttatcactccaggagagcagggtgttctttcatcacacatgaaattatttcaggatcagttccaagggagactttcatgtgtgattttatatatatatatatatatatatatatatatatatatatatatatatatatatgtatatatacacacacacatacacacatatatacacatatatatacacatatacacatatatatacacatatatataataagaacatttaccattttaactatttttaagtgtacacttcagtggcatgaagtacattatttccattattgtgcaactatcattttacattccaccagcagtgcacaaggcttccaatttctccacatacttgccaatattaattagtttgtttctctctcatttcataggcatgatcataactcactgcagccccaacctcctgggctcaagggatccttccacctcagcctcctgggtagctggaactacaggtgccactacacccaaatagttttttggtttttttgaaatggagtttcactctgtcacccaggctggagtgcagtggcaccatttcagctcactgcaacctccgcctcctaggtttaagtgattctccttcctcggcctcctgagtagctgggattacaggcatgtgccaccatgtatggctattttttgtatttttagtagagacagggtttcaccatgttggccaggccaggctagtctcaaactcctgtcctcaagtgatccacttaccttggcctcccaaagtgctgggattacaggcttgaaccactgcacttggcctccatattttttataatagccactctaacatgtatgaaatggtatctcattgtggttttgattttcctttacctaatggctagtgatgttgaaaatcttttcatgtacttcttggcactggatttggcaatgatttattggatatgacaccagaagcatgggaaacaaaagaaaaaataggtaaattggacttcaccaaaattgaaaactttcggcatcagtggacactatcaagaaagtgaaaaggagctgggtgtggtggctcacgcctgtaattccagcactttgggaggccaaggtgggaggatcacttgaggtcaggagtgcgagaccagcctggttaacttggtgaaaccacgtctctactaaaaataaaaaaaaagagaaaaaaaaaagccgggtgtggtggcatgtgcctgtaatcccagcaactcaggaagctgaggcaggaggatcgcttgaagctgtgaggtggaggttgcagtgagccgagatcatgctactgcactccagcccaggtgacagagcaagaaagcaaaattccatctcaaaaaaaaaaaaaaggccgggtgtggtggctcacgcctgtaatcctagcactttgggaggctgaggcaggtggatcacgaggtcaggagatcgaaaccatcctggctaatgtggtgaaaccctgtctctacaaaaaaatacaaaaaattagccaggctggtagtggaagcctgtagtcccagctacttgggaggctgaggaaggagaatggcgtgaacctggaaccagtgagcccagatctcaccactgcactccagcctgggcgacagagcgagactccgtctcaaaaaaaaaaaaggtgaatataggagaaaagacactgtaaaataatatacctgataagggtctagtatccagaacatataaagaactcttacaacccaacaacaaaaagacaacccaatatcaaaatgggcagaggacttgaagagacttttctgtaaagaagatatgcaaatagcatatgaaacgatactcaacatcactagccatcatggaaatataaatcaaaaatacaatgagataacactccatacccatcagaatgtcttattattttaaaaacaaaccagaaacaagtattgacaaagaagtggagaaatgtgaacaccgctgtaaaatggtaaagctgctatgactgacccttgctacaacgtggaggaacctcagaaacattgtgctgagaacccagcacaaggccacacacctgtaatcccagctactcgggaggctgaggtgggagggtcgcttgagcctgggagttcaagtccagtctgggcagcatagcaagactccatgtctacaaagataaaaataaaagcaatgtgcagaaagaggctggccacaaaaaggtcacatactgtatgataccacttatatgaaatacccagaatgggtaaatccaaagagagcatattggtggttgtcaagggtcggagggaggatgaaatgtgtgacagctgcttaatggatggaggatttcctttggggtgatgaaactattttggaactaagaggtggtggctgcacaatgttgtgcatggactaaatgtcacagaaatgtacatttttaaaagttaattttatattgtgtaaattttacctcaataaaaaaatctagtccacagc

SEQ ID NO: 201964 - DNA, 572 bp, Homo sapiens
  Payload ID: 19841
  Gene Name: zinc finger protein 268
  ENST ID: ENST00000541975
  CDS Start-End: 468-572
gcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttggtccacaggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtg

SEQ ID NO: 201965 - DNA, 612 bp, Homo sapiens
  Payload ID: 19841
  Gene Name: zinc finger protein 268
  ENST ID: ENST00000591951
  CDS Start-End: 1-334
gtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaattttgaaggctggaaagtccaaagccaaggtgctggcaggtttggtgtctggtgagggcctgctctgtgcttccaagatgacgccttgttgctgcatcctctggagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagta

SEQ ID NO: 201966 - DNA, 559 bp, Homo sapiens
  Payload ID: 19841
  Gene Name: zinc finger protein 268
  Uniprot ID: Q14587
  ENST ID: ENST00000588312
  CDS Start-End: 120-254
atctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttggggtaccaacacaccaaacctgatatcatcttcaagttggaacaaggagaagagctgtgtatggtgcaggcccaagttccaaatcagacctgtccaattttgaaggctggaaagtccaaagccaaggtgctggcaggtttggtgtctggtgagggcctgctctgtgcttccaagatgacgccttgttgctgcatcctctggagacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctag

SEQ ID NO: 201967 - DNA, 717 bp, Homo sapiens
  Payload ID: 19841
  Gene Name: zinc finger protein 268
  ENST ID: ENST00000500625
  CDS Start-End: 434-717
cggccgccattgttccgcgccgatggcgagatccttgttcctcagatagcgttcatcgcccgtcgtggtcaacgggccagccgagtctggagtggttgcgaacccttctggctgcagatctggagcatccctcgcgtcctgtcacttccagcgaggcacacaaaactgaccgtagggatggccaccagggtccggacagcttctatttggtccacaggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaaacacagtctggaaaattgatgatcttatggattggcatcaggaaaataaagacaagctgggaagtacggcaaaaag

SEQ ID NO: 201968 - DNA, 759 bp, Homo sapiens
  Payload ID: 19841
  Gene Name: zinc finger protein 268
  Uniprot ID: Q14587
  ENST ID: ENST00000539248
  CDS Start-End: 229-636
attgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagta

SEQ ID NO: 201969 - DNA, 686 bp, Homo sapiens
  Payload ID: 19841
  Gene Name: zinc finger protein 268
  ENST ID: ENST00000592241
  CDS Start-End: 120-500
atctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaattttgaaggctggaaagtccaaagccaaggtgctggcaggtttggtgtctggtgagggcctgctctgtgcttccaagatgacgccttgttgctgcatcctctggagacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctag

SEQ ID NO: 201970 - DNA, 583 bp, Homo sapiens
  Payload ID: 19841
  Gene Name: zinc finger protein 268
  ENST ID: ENST00000611984
  CDS Start-End: 218-583
ccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaattttgaaggctggaaagtccaaagccaaggtgctggcaggtttggtgtctggtgagggcctgctctgtgcttccaagatgacgccttgttgctgcatcctctggaggtga

SEQ ID NO: 201971 - DNA, 2000 bp, Homo sapiens
  Payload ID: 19842
  Gene Name: zinc finger protein 273
  Uniprot ID: Q14593
  ENST ID: ENST00000476120
  CDS Start-End: 72-1781
ggcttccgggatttggcggggcctttgtctctcgctgcagtcgcagctccaggtctcgtcttcactgctctatgtcctctgctcctagaggtccaccttctgtggccccgttacctgcaggtattgggagatccacagctaagacgccaggactccctggaagcctagaaatgggaccactgacatttagggatgtggccatagaattctctctggaggagtggcaatgcctggacacttcacagcagaatttgtataggaatgtgatgttagataactacagaaacctggtcttcctgggtattgctgtctctaagccagacctgatcacttgtctggagcaaggaaaagagccctgcaatatgaagagacatgcgatggtagccaaacccccagttgtgtgttctcattttgcccaagacctttggccaaagcagggcttaaaagattcttttcaaaaagtgatactgagaagatatggaaaatatggacatgagaatttacaattaagaaaaggctgtaaaagtgcggatgagcataaggtgcacaaaagaggttataatggacttaaccaatgtttgacaactacccagagcaaaatatttcaatgtgataaatatgttaaagtccttcataaattctcaaattcaaatatacataagaaaagacaaactggaaagaaacctttcaaatgtaaagaatgtggcaaatcatgttgcatactttcacaactaactcagcataagaaaactgctactagagtgaatttctacaaatgtaagacatgtggaaaagcctttaaccagttctcaaatcttactaaacataagataattcatcctgaagtgaatccctacaaatgtgaagaatgtggcaaagcctttaaccagtccttaactcttactaaacataaaaaaattcatactgaagagaaaccttacaaatgtgaagattgtggcaaagtctttagtgtattttcagtccttactaaacataagataattcatacaggaacaaaaccctacaattgtgaagaatgtggcaaaggctttagtatattctcaacccttactaaacataagataattcatactggagagaaaccctacaaatgcaatgaatgtggtaaagcctttaactggtcctcaactcttactaaacataagagaattcatactggagagaaaccctacaaatgtgaagaatgtggcaaagcttttaaccagtcctcaacccttactagacataagatagttcatactggagagaaaccctacaaatgtgaagaatgtggtaaagcctttaaacggtccacaactcttactaaacataagagaatttatactaaagagaaaccatacaaatgtgaagaatgtggaaaagcctttagtgtattctcaacccttactaaacataagataattcatactggagcaaaaccttacaaatgtgaagaatgtggcagtgcctttagggcattctcaacccttactgaacataagagagttcatactggagagaaaccttacaaatgcaatgaatgtggtaaagcctttaactggtcctcaactcttactaaacataagagaattcatactggagagaagccctacaaatgtgaagaatgtggcaaagcttttaaccggtcctcaaaccttactcgacataagaaaattcatactggagagaaaccatacaaacctaaaagatgtgacagtgcttttgacaacaccccaaacttttctagacataaaagaaatcatatgggtgagaaatcctagaaatgtgaagaatgtgacaaagcctttaagcggttgtcacacttgattgtatataagataattcatactggagaaaactcccagaagtggagttttccttattgcacaggaaagcatttatacttgagaaaaattgtataaagaatggaaaagtcattaatatctgctcatatcttaacatcagcgagttggtatttaataaaagcattatcaatgaaa

SEQ ID NO: 201972 - DNA, 3757 bp, Homo sapiens
  Payload ID: 19842
  Gene Name: zinc finger protein 273
  ENST ID: ENST00000395375
  CDS Start-End: 31-231
cgcagctccaggtctcgtcttcactgctctatgtcctctgctcctagaggtccaccttctgtggccccgttacctgcaggtattgggagatccacagctaagacgccaggactccctggaagcctagaaatggccagaaaaactgggaaaatcacaggctcttccacttactggatgtttgacaaaatattcttcttgggccaaaaacattggcattactgggaccactgacatttagggatgtggccatagaattctctctggaggagtggcaatgcctggacacttcacagcagaatttgtataggaatgtgatgttagataactacagaaacctggtcttcctgggtattgctgtctctaagccagacctgatcacttgtctggagcaaggaaaagagccctgcaatatgaagagacatgcgatggtagccaaacccccagttgtgtgttctcattttgcccaagacctttggccaaagcagggcttaaaagattcttttcaaaaagtgatactgagaagatatggaaaatatggacatgagaatttacaattaagaaaaggctgtaaaagtgcggatgagcataaggtgcacaaaagaggttataatggacttaaccaatgtttgacaactacccagagcaaaatatttcaatgtgataaatatgttaaagtccttcataaattctcaaattcaaatatacataagaaaagacaaactggaaagaaacctttcaaatgtaaagaatgtggcaaatcatgttgcatactttcacaactaactcagcataagaaaactgctactagagtgaatttctacaaatgtaagacatgtggaaaagcctttaaccagttctcaaatcttactaaacataagataattcatcctgaagtgaatccctacaaatgtgaagaatgtggcaaagcctttaaccagtccttaactcttactaaacataaaaaaattcatactgaagagaaaccttacaaatgtgaagattgtggcaaagtctttagtgtattttcagtccttactaaacataagataattcatacaggaacaaaaccctacaattgtgaagaatgtggcaaaggctttagtatattctcaacccttactaaacataagataattcatactggagagaaaccctacaaatgcaatgaatgtggtaaagcctttaactggtcctcaactcttactaaacataagagaattcatactggagagaaaccctacaaatgtgaagaatgtggcaaagcttttaaccagtcctcaacccttactagacataagatagttcatactggagagaaaccctacaaatgtgaagaatgtggtaaagcctttaaacggtccacaactcttactaaacataagagaatttatactaaagagaaaccatacaaatgtgaagaatgtggaaaagcctttagtgtattctcaacccttactaaacataagataattcatactggagcaaaaccttacaaatgtgaagaatgtggcagtgcctttagggcattctcaacccttactgaacataagagagttcatactggagagaaaccttacaaatgcaatgaatgtggtaaagcctttaactggtcctcaactcttactaaacataagagaattcatactggagagaagccctacaaatgtgaagaatgtggcaaagcttttaaccggtcctcaaaccttactcgacataagaaaattcatactggagagaaaccatacaaacctaaaagatgtgacagtgcttttgacaacaccccaaacttttctagacataaaagaaatcatatgggtgagaaatcctagaaatgtgaagaatgtgacaaagcctttaagcggttgtcacacttgattgtatataagataattcatactggagaaaactcccagaagtggagttttccttattgcacaggaaagcatttatacttgagaaaaattgtataaagaatggaaaagtcattaatatctgctcatatcttaacatcagcgagttggtatttaataaaagcattatcaatgaaattactgtcaaaagatctttcagacaatataagcctgcaaagtgcagcagagtatttattttgaagagaaacattaaaagtacaaagaggtttgtagtacctttgtttgtatcatagatcttattgtacacattttgtaccagagaaaaaccctgaagcagttgttcaaactttgttcaataccaggaaatttatattggagaaaaaccctatgagtgtaatgaatttggaaaaatatttttttcaacaacagcttagaaaacatgggaggaattacactaaaatatatttttgcaaatgcagcagtaaatatgaaagaaatgatccaaagttaggtttatataaatatcagagaattcacaatacagatatctaagatactgacacttcagacattacacaaaatcagagtgctgagtacagaaagttatccaaaacaaaagttggtagataactaatagtgaacaagtttttggcagaggtatatttacattcagagtacacttttctttggaaaaaattacaggttttttgaaaagtgaataatgtaattcaactctcaaattcatggtttttttttttttggttttggttttgggttttttgtttgtttgtttgtttgtttttgagacggagtttcactcttgttgcccaggctggagtgcaatggcgtgatctcagctcaccgcaacctctgcctcccagattcaagcaattctcctgcctcagcctccctagtagctgggattacaggcatgtgccacacctggctaatttttgtggttttagtagagacagggtttctccatgttggtcagtctggtctcaaactcccaacctcaggtgatatgcccgcctcggcctcccaaaatgttgggattacaggcatgagccactgcacccggcgcatgttttttcttcattcctattgtattcacatgtgaaagcatgtgatcaacttgctgcatcaaagatatgagatttttttttttattaggtgggcattatttatgaccttttctgtggaagagtaagaacattaaaatgaaagatgcatgatgaaaatctaagtagagaggctcttgtggttaactgataatattgagtgatgcatgaggtaggtgttcagagtaatattctgcattatagtgaaaaatttttaatattaaaattcaattatatcattttatgaattgtgcttttcataatgcagtacatttcaaaatttttagattatgtatgaacttagatttttaaacatgttttaacatgttaagacttgtgcattcagtgaagcgttattatgccacaaactaacctacctcaccttactcaatggtgtaggtaaaagatgatagcaatatattatttggttacatagtggactaacatttttagtaatctcttttgccagtggctttaaactgcagataagttaaatattcccataggttttacatttatattttttcttatttaaatttattgttcttatttttcatgggtacatagtatgtttttatgctgtatatggcatgttttgatacaggtatataatatgtaataatcacatcagggtaaatgaggtatcccttactagcatttatcctttgtattttattttaaaatgtacaactaaattgttatggactacagggttatttttatggtcataataaaaattacaaaagtatgaataaaatacataca

SEQ ID NO: 201973 - DNA, 2678 bp, Homo sapiens
  Payload ID: 19843
  Gene Name: zinc finger protein 274
  Uniprot ID: Q96GC6
  ENST ID: ENST00000345813
  CDS Start-End: 402-2267
gtccagcgcctttcctttctccagcttctgctctgccccaagagtggtcgccttcgtggcagggcacgactctctcccagctcgggtcgccgcccacattagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccgggactctgcccacttccaccagagacacattgagaaggaggaaactatggcctccaggcttccgacggcctggtcctgtgaaccagtgacctttgaagatgtaacactgggttttaccccggaagagtggggactgctggacctcaaacagaagtccctgtacagggaagtgatgctggagaactacaggaacctggtctcagtggagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggaggccctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagtgaggacattcccaaaaccaaaggacaactgaggagactgcccagcacataatgaataaataagaaaatgagtgaggagttattaacatcatttggaaaaaagatttcccattcacttgatattgtttgttcactcatttagtcattaaaagtgagattaataaaatctgaaaatgttatataataactttaaaaagccaggtaattaataatctgcactgatattacatccacagtaccacagtatttatgtgtatgaattaaggattaaaagataatgtggataaataaactattgatctatg

SEQ ID NO: 201974 - DNA, 2447 bp, Homo sapiens
  Payload ID: 19843
  Gene Name: zinc finger protein 274
  ENST ID: ENST00000326804
  CDS Start-End: 203-2038
gtgcggcgcgcgccgggactctgcccacttccaccagagacacattgagaaggaggaaactatggcctccaggcttccgacggcctggtcctgtaatctggatttttaggaaccagtgacctttgaagatgtaacactgggttttaccccggaagagtggggactgctggacctcaaacagaagtccctgtacagggaagtgatgctggagaactacaggaacctggtctcagtggaacatcagctttccaaaccagatgtggtatctcagttagaggaggcagaagatttctggccagtggagagaggaattcctcaagacaccattccagagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggaggccctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagtgaggacattcccaaaaccaaaggacaactgaggagactgcccagcacataatgaataaataagaaaatgagtgaggagttattaacatcatttggaaaaaagatttcccattcacttgatattgtttgttcactcatttagtcattaaaagtgagattaataaaatctgaaaatgttatataataactttaaaaagccaggtaattaataatctgcactgatattacatccacagtaccacagtatttatgtgtatgaattaaggattaaaagataatgtggataaataaactattgatcta

SEQ ID NO: 201975 - DNA, 2539 bp, Homo sapiens
  Payload ID: 19843
  Gene Name: zinc finger protein 274
  Uniprot ID: Q96GC6
  ENST ID: ENST00000424679
  CDS Start-End: 474-2120
cgcccccaccgccacccaaccaagcatcacccattccagcacttccggcctgacccctgtccagcgcctttcctttctccagcttctgctctgccccaagagtggtcgccttcgtggcagggcacgactctctcccagctcgggtcgccgcccacattagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccggagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggaggccctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagtgaggacattcccaaaaccaaaggacaactgaggagactgcccagcacataatgaataaataagaaaatgagtgaggagttattaacatcatttggaaaaaagatttcccattcacttgatattgtttgttcactcatttagtcattaaaagtgagattaataaaatctgaaaatgttatataataactttaaaaagccaggtaattaataatctgcactgatattacatccacagtaccacagtatttatgtgtatgaattaaggattaaaagataatgtggataaataaactattgatctatgtctgtgta

SEQ ID NO: 201976 - DNA, 544 bp, Homo sapiens
  Payload ID: 19843
  Gene Name: zinc finger protein 274
  ENST ID: ENST00000594839
  CDS Start-End: 234-544
gactctgcccacttccaccagagacacattgagaaggaggaaactatggcctccaggcttccgacggcctggtcctgtaacatcagctttccaaaccagatgtggtatctcagttagaggaggcagaagatttctggccagtggagagaggaattcctcaagacaccattccagagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggaggccctggaccagctccgagagctgtgtcaccagtggctacagcctaaggcacgctccaaggagcagatcctggagctgctggtgctggagcagtt

SEQ ID NO: 201977 - DNA, 709 bp, Homo sapiens
  Payload ID: 19843
  Gene Name: zinc finger protein 274
  ENST ID: ENST00000597528
  CDS Start-End: 473-709
agaaccgttagttgggggcgagcgcggcctctgcattttccgccgagctcgggtaccctgagccggccgtgcctgcagtcctcccgccgctctgtgggatggggtcggtgacccggaaccccgaggggagacagtgctttcggggcgccgcggtggagagaacagatcgcctccggaagcgtggggtctgggccagggaggcgatcccctccgatgcgcgggacagaggaggctcggtgtcctctcggggaggggaaaactggtcctatccagtcctgtgggagtcctatgactcactctgggcgttttccagtttgggtggacttgtcatttcccgctgagggagccgttcctgggcggaggctgcggtagctccccagcggacaccttaagcctctccctcccctcccaacttcggtttcctcaggactctgcccacttccaccagagacacattgagaaggaggaaactatggcctccaggcttccgacggcctggtcctgtgaaccagtgacctttgaagatgtaacactgggttttaccccggaagagtggggactgctggacctcaaacagaagtccctgtacagggaagtgatgctggagaactacaggaacctggtctcagtggaacatcagctttccaaaccagatgtggtatctcagttagaggaggcagaagatttctggccagtggagagaggaatt

SEQ ID NO: 201978 - DNA, 2559 bp, Homo sapiens
  Payload ID: 19843
  Gene Name: zinc finger protein 274
  Uniprot ID: Q96GC6
  ENST ID: ENST00000610905
  CDS Start-End: 189-2150
gcgaaacctgcgtccgtcgggggctgcgctgggcgggtccagaaccgttagttgggggcgagcgcggcctctgcattttccgccgagctcgggtaccctgagccggccgtgcctgcagtcctcccgccgctctgtgggatggggactctgcccacttccaccagagacacattgagaaggaggaaactatggcctccaggcttccgacggcctggtcctgtgaaccagtgacctttgaagatgtaacactgggttttaccccggaagagtggggactgctggacctcaaacagaagtccctgtacagggaagtgatgctggagaactacaggaacctggtctcagtggaacatcagctttccaaaccagatgtggtatctcagttagaggaggcagaagatttctggccagtggagagaggaattcctcaagacaccattccagagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggaggccctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagtgaggacattcccaaaaccaaaggacaactgaggagactgcccagcacataatgaataaataagaaaatgagtgaggagttattaacatcatttggaaaaaagatttcccattcacttgatattgtttgttcactcatttagtcattaaaagtgagattaataaaatctgaaaatgttatataataactttaaaaagccaggtaattaataatctgcactgatattacatccacagtaccacagtatttatgtgtatgaattaaggattaaaagataatgtggataaataaactattgatcta

SEQ ID NO: 201979 - DNA, 2538 bp, Homo sapiens
  Payload ID: 19843
  Gene Name: zinc finger protein 274
  Uniprot ID: Q96GC6
  ENST ID: ENST00000617501
  CDS Start-End: 179-2140
ggccagtcaagatggccgccgctgggtgaggcaagctggcgcgccgcgggggcgtctgggagttgtagttcgggacggcgggctgacgcacttcgccgccggccgacgggcgccattgtgcggcgcgcgccgggactctgcccacttccaccagagacacattgagaaggaggaaactatggcctccaggcttccgacggcctggtcctgtgaaccagtgacctttgaagatgtaacactgggttttaccccggaagagtggggactgctggacctcaaacagaagtccctgtacagggaagtgatgctggagaactacaggaacctggtctcagtggaacatcagctttccaaaccagatgtggtatctcagttagaggaggcagaagatttctggccagtggagagaggaattcctcaagacaccattccagagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggaggccctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagtgaggacattcccaaaaccaaaggacaactgaggagactgcccagcacataatgaataaataagaaaatgagtgaggagttattaacatcatttggaaaaaagatttcccattcacttgatattgtttgttcactcatttagtcattaaaagtgagattaataaaatctgaaaatgttatataataactttaaaaagccaggtaattaataatctgcactgatattacatccacagtaccacagtatttatgtgtatgaattaaggattaaaagataatgtggataaataaa

SEQ ID NO: 201980 - DNA, 5920 bp, Homo sapiens
  Payload ID: 19844
  Gene Name: zinc finger protein 275
  Uniprot ID: Q9NSD4
  ENST ID: ENST00000370249
  CDS Start-End: 1372-2502
ctctgtctcttgccccagcatgacacacggcagagtatgaaccccagctgctgccttcctaccctccctctgcttctcttctggaggctgccaaggattggatgtccactgggcttggagttccaatcatccaggtggggaagctgagtttccatccaggaaagtgattgaatggaggtcccttggaaagacgagaggccaggtccatggcccagggatcctagtgcttgatcaggttctcttttcaggacttcttggagctgtggttaggcctccatgttagcaacagacacccactccagaccctcacctcttgaccctggcattactggcgctgcccctgcctcattctaaaatagatggaaagactgatgagccctgggaattctttcaggatttggtgacatttgatgatgtggcatggtacctcaccacaagggagtggtttaagctggaccctgaacagagggcactggaatattatgggaacgtgacctctgtgggtaaggatgtcccagcccttcctcaaattcaccaccttcttggagtggggcaggggacacatggctacccccacagaagctcaccttctccctgggttgtggggaaacacaatgggtctgccacacctgatatgtcagagtagtatgagctcccccaactcctcttggcatggaaagaacccctctcagtcttttactgggaaagaaattagaacactgccactgtaatgtagaatgcccttttcattttaatgcacaaattatgcaaattgcatggccatttggtttgagtttatttgtgagaaaggttgacgtgatcaagatcttgttcacccattaggggtctgcatgtgtgcagtggggaggaggttttaggaggagagacgttgggagtcagatttgggagctgtcgaagtccacgtgtctgggaagagcatgaagttaaatgtgtgagctctgagtgggtggacagagagaagacagggtgaagatcacctcctcagggtggccacttgatactccacagagcctccccaaggtgggcccagaggctgccttcctcaagctcctggaaggagcctgaccttgggaaacacctttgaactgaatgaatgacttgcctaaagcctggtctttgaagattgaagggggttccccttcaaaggccttgcctatgttcctccactattctcatgtcatctctggctgttgccataaccaatctcctttcccatgagcaggcgttcctgttttaaatcctgccttggtccctcacctggcacaaggacaagtgctactggtgtcagacccatcgcccaacactgatcctgctaagtactctgaaagcacctccgcgacccgacaccagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgtggggacacctttcggcttaaagtcctgcttgtccagcaccagagagtccacagtgaggagaagggctgggaatgtggcgactgcgggaaggtctttaggggggtggcggagtttaatgagcacaggaaaagccacgtagctgcggagccccagcccggccccagtagggccctggagaatgccgcggagaagagggagcagatggagagggaggcaaagcccttcgagtgcgaggagtgcggaaaacggtttaagaagaatgcaggcctgagtcagcatctgagggtccacagcagagagaagccctttgattgcgaggaatgcgggcggtcgttcaaagtcaacacccacctcttccgacatcagaaacttcacacttcggaaaagcctttcgcctgcaaggcgtgcagcagggatttcctggatcgccaggagcttctcaagcaccagcgcatgcacactggccacctgcccttcgactgcgacgactgcggcaagtccttccgaggggtcaacgggctggccgagcaccagcgcatccacagtggggccaagccatacgggtgtccccactgcggcaagctcttccgaaggagctcggagctcaccaagcaccggcggatccacacgggcgagaagccctacgcctgcggccagtgcggcaaggccttccgccagagctccagcctcctggagcacgcacgcatccacagtggcgagcggccctacgcatgcggcgagtgtggcaaggccttccgtgggccctctgacctcatcaagcaccggcgcatccacagcggactgaaaccctatgagtgcgacaaatgcggcaaggccttccgccggagctccggcctcagtcgccaccggcggatccacagtggggcgcggcgctgcgaatgcagccagtgtggccgcgtgttcaagaggcgctcggcactgcagaagcatcagccaacccaccacgagtagaaacgccctgtggtcccgcgggacagggacggagtccccagaggggatggcagagtcaaaggagatgaacagttttgtagcgcttatatattttgtcttccaaaaggttgagaccgatttatactgccaccagcaatttataagtgttacgttatgcccatcaagagtagcttgtaccatttaacttagtttggctagtttaactggtaggaagtaccatcaaggtatttcagtccacatgccttgaatccaagaatgagagaggacaaatctggatgtggggtagggaggggcttagaggtcatcaactccaagctccccccgccccagagaaacacacagagctgttccacgatggcgtcctcataatgtgatcccagctttcctgaagagaacgttgccctcatgatttttggcctacttgaatttataaatttttagggatgtaaatagaacactcaaatgtcttaaaatatttaatttattaatttagttatacatacatactgtaaatcacatattatataaaataatatattaatttagaaaataccccatttttgccaccctccctttcacgaaatcattttactctgactcctcaccgtcttcaccaacatgggaaccctgtttgagtcatcagacagtttcaagacacacccagtcacttccatccgagctctgcacggtcgctcagtgacgatcccttcatgaggctctcattagaaattttctcccaagccataagaccatatttgcagaacattaggacgatttctcttgtcgttttttaatctgtcctgtgactgtacaatataaccacttaaggtcatactttttcaaacaacctttaaacgtcttttcttttaaagcacccaaaatgtcattgtgaggccaaacgcctagtaacagttactgaatctgggttaaatgtcggtatctttttttcttaaaccatttcaatttggtgtcccctatacatatccaaaactagcatcgattggggttgttttgaactaatgggtcttgtcctcaagcagcactattttgttcaaaataaaatagttgagagcatgcccctaagaagagatacatctcaaggactcaagtgcagggtgacgcctccttttggaaatgagcctctcctggtatcaggcctagatggtacttctccagccttccgtttcttgttctataaaacaggggtgatcacagcacctacctccgaaggttatcacgaggactgccatcgtggctgcagagtgccaggaccaccggcctggtatggaggtacacactcagtgaaggccatctgctgtcattgtcattgtcatagttattgccgtcattctgtggcttgtcaattccagaactggggatagaccccaggcctcctgaccaccagtctcatctttctcttatgcgatgacttaaatggtgtttctgttttttgcatgcaaatggtccgttcatctcctttgactagttatcaacttaccttcggatatattaactttatgtagcagttctttctatattgatggtgatgttctcttttccaattttattgctttgctttttgtagcagttttattacgtttttgttgtgaaagcttttaatttttacatatccaagcattcattttttgtccactcagtcataactttcattgcttctgtagctagatatgatgacattttctctagaattttaattacaaacaaaaagctgcaaccccagcccatcagaaggtgagtacaccaggtgggcaggctggatggaaatgggccagagaagcaggctctttcctcatccgagatgcggactccctgtctatctgtgggcaccacttgactatccaacctgaccactgcggcacactggagatgctcccatcatagattagccagaactctgtgactgctcatcattatagaccccgccagcagcagtggggcttggcctcacctagatcaatggagtggtccaaacttggtctgggagcaagcagcccagccatcctttgagctcctgggagccttggcaatgctccgagtggattcagtgactgagcagcagattcacccaagaaacatctccttggacacaagaagacttgcctagaccacatcctcctttcagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagatcatttcttgcctctggtaacttgggggtggatttccttgggctctctaggtgtactgctatgtcagatgcaaaatgtcacccagcttcctgtcacatatccttgtctgt

SEQ ID NO: 201981 - DNA, 6320 bp, Homo sapiens
  Payload ID: 19844
  Gene Name: zinc finger protein 275
  ENST ID: ENST00000370251
  CDS Start-End: 178-1167
aaacgcgccgcggggctgttagctcggctgggcacgggcggctccgtggcgcttcctgccacgccaggcctgcctgggccgcgccagcgccgctccaccgagggccgcgcgtcggccgccgccgggcctggatggggccttacctgccaggctgatcccttggagtagttctgaggcatgatgagtcatccgtgtgtgtctcttttgggcgttcctgttttaaatcctgccttggtccctcacctggcacaaggacaagtgctactggtgtcagacccatcgcccaacactgatcctgctaagtactctgaaagcacctccgcgacccgacaccagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgtggggacacctttcggcttaaagtcctgcttgtccagcaccagagagtccacagtgaggagaagggctgggaatgtggcgactgcgggaaggtctttaggggggtggcggagtttaatgagcacaggaaaagccacgtagctgcggagccccagcccggccccagtagggccctggagaatgccgcggagaagagggagcagatggagagggaggcaaagcccttcgagtgcgaggagtgcggaaaacggtttaagaagaatgcaggcctgagtcagcatctgagggtccacagcagagagaagccctttgattgcgaggaatgcgggcggtcgttcaaagtcaacacccacctcttccgacatcagaaacttcacacttcggaaaagcctttcgcctgcaaggcgtgcagcagggatttcctggatcgccaggagcttctcaagcaccagcgcatgcacactggccacctgcccttcgactgcgacgactgcggcaagtccttccgaggggtcaacgggctggccgagcaccagcgcatccacagtggggccaagccatacgggtgtccccactgcggcaagctcttccgaaggagctcggagctcaccaagcaccggcggatccacacgggcgagaagccctacgcctgcggccttccgtgggccctctgacctcatcaagcaccggcgcatccacagcggactgaaaccctatgagtgcgacaaatgcggcaaggccttccgccggagctccggcctcagtcgccaccggcggatccacagtggggcgcggcgctgcgaatgcagccagtgtggccgcgtgttcaagaggcgctcggcactgcagaagcatcagccaacccaccacgagtagaaacgccctgtggtcccgcgggacagggacggagtccccagaggggatggcagagtcaaaggagatgaacagttttgtagcgcttatatattttgtcttccaaaaggttgagaccgatttatactgccaccagcaatttataagtgttacgttatgcccatcaagagtagcttgtaccatttaacttagtttggctagtttaactggtaggaagtaccatcaaggtatttcagtccacatgccttgaatccaagaatgagagaggacaaatctggatgtggggtagggaggggcttagaggtcatcaactccaagctccccccgccccagagaaacacacagagctgttccacgatggcgtcctcataatgtgatcccagctttcctgaagagaacgttgccctcatgatttttggcctacttgaatttataaatttttagggatgtaaatagaacactcaaatgtcttaaaatatttaatttattaatttagttatacatacatactgtaaatcacatattatataaaataatatattaatttagaaaataccccatttttgccaccctccctttcacgaaatcattttactctgactcctcaccgtcttcaccaacatgggaaccctgtttgagtcatcagacagtttcaagacacacccagtcacttccatccgagctctgcacggtcgctcagtgacgatcccttcatgaggctctcattagaaattttctcccaagccataagaccatatttgcagaacattaggacgatttctcttgtcgttttttaatctgtcctgtgactgtacaatataaccacttaaggtcatactttttcaaacaacctttaaacgtcttttcttttaaagcacccaaaatgtcattgtgaggccaaacgcctagtaacagttactgaatctgggttaaatgtcggtatctttttttcttaaaccatttcaatttggtgtcccctatacatatccaaaactagcatcgattggggttgttttgaactaatgggtcttgtcctcaagcagcactattttgttcaaaataaaatagttgagagcatgcccctaagaagagatacatctcaaggactcaagtgcagggtgacgcctccttttggaaatgagcctctcctggtatcaggcctagatggtacttctccagccttccgtttcttgttctataaaacaggggtgatcacagcacctacctccgaaggttatcacgaggactgccatcgtggctgcagagtgccaggaccaccggcctggtatggaggtacacactcagtgaaggccatctgctgtcattgtcattgtcatagttattgccgtcattctgtggcttgtcaattccagaactggggatagaccccaggcctcctgaccaccagtctcatctttctcttatgcgatgacttaaatggtgtttctgttttttgcatgcaaatggtccgttcatctcctttgactagttatcaacttaccttcggatatattaactttatgtagcagttctttctatattgatggtgatgttctcttttccaattttattgctttgctttttgtagcagttttattacgtttttgttgtgaaagcttttaatttttacatatccaagcattcattttttgtccactcagtcataactttcattgcttctgtagctagatatgatgacattttctctagaattttaattacaaacaaaaagctgcaaccccagcccatcagaaggtgagtacaccaggtgggcaggctggatggaaatgggccagagaagcaggctctttcctcatccgagatgcggactccctgtctatctgtgggcaccacttgactatccaacctgaccactgcggcacactggagatgctcccatcatagattagccagaactctgtgactgctcatcattatagaccccgccagcagcagtggggcttggcctcacctagatcaatggagtggtccaaacttggtctgggagcaagcagcccagccatcctttgagctcctgggagccttggcaatgctccgagtggattcagtgactgagcagcagattcacccaagaaacatctccttggacacaagaagacttgcctagaccacatcctcctttcagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagatcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacatgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatggtatgttcttggatttctggcagcagccctcattggtccacgtgcgtccccactacagactccttgacttgagccagcttgagtgggtctctactcttttctattgtgttttgccacttggctgcttcctggccaagtcgcacctgactgcatgaacacctgttcaaacgtgtgttctctgttctctaagatgggtgaaagtcgatgccttctagtctcagtgaatttaacctgtgattttatgtctacgtatattgttcctttactgaacccaccacatgcgggccataaaatgagtgaaatcacagtgcaccctgttctcttatttttgaagtgtttcacgatttccagcatgtccatcagatggggggattgctaacttctctcttactcatgtacttacattctgtagttctcattgcatcactttggatgtttactttgaaaagcagaaactgtctctttaaacttggccctcaatgtcatttgcgtatctctgagaacaatagctatgtcccaccccagtttgtatttccgttggttgttggcacttttttctcattcccccatctcattaccttgtctgttttctggcactcactataatcagccttgcactagagctgtttgtggacttggcttcaccccctcctcctcagccctcccccacccattaaattgtgagctcttagaagacaggggtggcctttcatgtctgatcccctaccaaatctagcacagtgccttgcatcaagtagatttcaataaatatatgttaaatggca

SEQ ID NO: 201982 - DNA, 4589 bp, Homo sapiens
  Payload ID: 19845
  Gene Name: zinc finger protein 276
  Uniprot ID: Q8N554
  ENST ID: ENST00000289816
  CDS Start-End: 313-1932
gcacttccggcgacgggccccctccgcgcgtactgcgggccccacgggtgttagtggcgggggcggcagagtccgggtgggttgtcgcgacggagccgggcctcttcgccgtcttgagacggggctggcgagaagggcccctcacggagttgccatgggcgtctaaccgcggcagccaggcccctctctacgtgagaccccggcccccctcccctttctgcagcccgcccgccacctgcgcgccgcgtggcctccgccggcgcctgcccgccccgcgcctccgtctcccacggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcgggtaaaagacgagttcagtgacctttctgagggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctggtgtgcagtggcaggtcccgtcagaagagatgaggctcctgggacaggtcagcgtcaggggcagcctgctgtctgctctggagggcggcgctcacctctgggtcgcagtccccacgatcagccagcagctgtgagagaggagcaggtcctcagcccatgccgcccactaggcctcagaccacaggggaggggctctggcagaaatagtcgagttgtattgccagccaggcaggcacatggcccaggcagctgtcaattctcatgtcccccacatggcccaaggtgggcatcttgacgttacctctgccacgtgtgagaagctctttttcgggcaccgaggtattaactgcagcagaaaaagacgagcttttgttatcagttccacggggttgccctagagagaaaacaggcaaactcacaggttagaagacatacagaaacagggctggtgtgtcccccatagtctgcatgctgtgccggaacattctttggcagaaggagcctccggctggggggagctcccctggaggtgggactggcccttgcacctgcctgacccttgagctccaggctcctgccagctggaggtgaaactgtgcttgtatccccagccacgaagagctggaccagcttcaagtacatgtccacagcaacatgcaggaaggcctcttccctgatggccgcgtcttcatggaagtaggagagaagactagaggtaaagacatagtgacaaatggctacagactgctggaaaggtagcaggtgatgccaagggatactgctcatctgtggagcagaggcacagacaacccttcccatctggcgggacccagaggtgctgagatgggggtctgggaaacactgcccagccctgaccagccctgtgggtggaggtacctgtaaaaagcgaaaggcagcagcctggtgtgctgatccggggccacacggaggaggagccgccccagcctgaggtctgcaacaccaagaagtggctcaggcaactctggacatctctgcctattatcagtgctggggacacccctgggggtcgggacgtgtaccctgggaggcctggctgtggggatagtgtggggcgaacagcctgagctgaggatacccaggtacctgtcagcagctgggagaggatgggggggtcgacctcttgcaggagggtgggtgtggtgcagagagaggcagtccccatgataggcccattggtcctggggttgaccagtgagccagtaaattatcttattgctttaaacaagtttgtgcttaatctgtcccaactaaaatggagcttataaacttacttagcaaggaacctcaaggagggctcgttcttaaccatttgcaagatgcctctgaaaagagcggccctccgcatttgtgcctcagcagcgtgtttcttaccactctctgtcaactgaaagagtgccagccaggatatcttcctcttctctaaacactcgaggattgctgcacaaacgtggaaagcctttggcaggtctgtggtgctctgtaaaccgcaggagaccaaccctgagaatggccgacctggtgctcccatgggtaggagggtacagccctcagcacagaagagggcatttcctctttgcttattgtaagtcttaaaactggtgacagttttacctatagaaggtaatactgggcctctggacagaagaggctcaggtaggaggccagggacttcgagcacccacaccaaggctgctgcaccacgtcctcaaataagacattaaaagaaaggcccacaggccggatgcagtggctcatgcctgtaatcccaacactttgggaggccgaggtcggcggatcactgaggccagttcaagaccagcctggcaatatggtgaaaccccgtctctactaaaaatacaaaaattagccgggtgtgacagactcacgcctgtaatcccagctactcgggaggctgatgcaggagaattgcttgaacccaggaggctgaggttgcagtgagctgagatcacaccactgcactccagcctgggtgacagagtgagacccccatctcaaaaaaaaaaaaaaaaaacccacggcctgggagttctcactcacacttccgcaaacacaaggagctcctgagctagtctggaaaccctgacttggaagctggctgcctggtgcccctgcctggcccacagtgggagaggacaccttggctggtaaggtctgacttacatttgaggtcagatgtgacgacagcaggcccatcaaggagaagaagaaaaggaaaaccaatagctgtaaataaaaacgtgcacttattattacattaaaa

SEQ ID NO: 201983 - DNA, 2267 bp, Homo sapiens
  Payload ID: 19845
  Gene Name: zinc finger protein 276
  Uniprot ID: Q8N554
  ENST ID: ENST00000443381
  CDS Start-End: 98-1942
ctcgcttccagcgcgccgagcggagcctaacgccgggtcctctaggaacctcgggccgggcagcacccgcgggattctgctggcgtcctccgctgccatgaagcgggaccggctgggccgcttcctgtctcctgggtcgtcccgacagtgcggggcctcggacggcggcggcggcgtcagccggactcggggccgcccttcccttagcggtgggccgagggtggacggggcgacggcgcggcgcgcctggggcccggtggggtcctgcggggacgcgggcgaggacggcgcggacgaggcaggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcgggtaaaagacgagttcagtgacctttctgagggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacggga

SEQ ID NO: 201984 - DNA, 588 bp, Homo sapiens
  Payload ID: 19845
  Gene Name: zinc finger protein 276
  ENST ID: ENST00000563541
  CDS Start-End: 1-283
atgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagaggtgatgcctgcaacgcgaggctcgccctgcctgtcggggccggggctccatgcatgctcttcattgcagggaggagcttcccaccatctacaagtgtccttaccagggctgcacggccgtgtacc

SEQ ID NO: 201985 - DNA, 1826 bp, Homo sapiens
  Payload ID: 19845
  Gene Name: zinc finger protein 276
  ENST ID: ENST00000562530
  CDS Start-End: 204-1046
aaatctaccatctctgcccagaaaaatgcacgaacgcacggacctgcccgtcactcggattttggaaggtggcctggcggaccctcctgctacatctcctctacaggtggagcccaggctgtgatgcaccggctcagcgagcggagtggaaagccaaggtccgcaggatctgagctgtccaaggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctg

SEQ ID NO: 201986 - DNA, 2203 bp, Homo sapiens
  Payload ID: 19845
  Gene Name: zinc finger protein 276
  ENST ID: ENST00000568064
  CDS Start-End: 291-1592
tccgcgcgtactgcgggccccacgggtgttagtggcgggggcggcagagtccgggtgggttgtcgcgacggagccgggcctcttcgccgtcttgagacggggctggcgagaagggcccctcacggagttgccatgggcgtctaaccgcggcagccaggcccctctctacgtgagaccccggcccccctcccctttctgcagcccgcccgccacctgcgcgccgcgtggcctccgccggcgcctgcccgccccgcgcctccgtctcccacggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtaagtgtgagtcaggaccccctcccagggctgtggccctcgcaccttcttatctgcctctgtcccccaggtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttt

SEQ ID NO: 201987 - DNA, 2206 bp, Homo sapiens
  Payload ID: 19845
  Gene Name: zinc finger protein 276
  ENST ID: ENST00000568295
  CDS Start-End: 69-1136
acgccgggtcctctaggaacctcgggccgggcagcacccgcgggattctgctggcgtcctccgctgccatgaagcgggaccggctgggccgcttcctgtctcctgggtcgtcccgacagtgcggggcctcggacggcggcggcggcgtcagccggactcggggccgcccttcccttagcggtgggccgagggtggacggggcgacggcgcggcgcgcctggggcccggtggggtcctgcggggacgcgggcgaggacggcgcggacgaggcaggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacggga

SEQ ID NO: 201988 - DNA, 1849 bp, Homo sapiens
  Payload ID: 19846
  Gene Name: zinc finger protein 277
  Uniprot ID: Q9NRM2
  ENST ID: ENST00000361822
  CDS Start-End: 130-1482
gtccagagcgcggcgtaggtgtggagaaaacattacgtcgacggggagttcgcctccagtagcgtttctactggtgccaccccgcctccgacccgccctgcggccctcccttttcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtacattttatattggaggaaaaggttcactgaacagcccatcacagatttttgtagtgtaataagaattaattccactgctccatttgaagaacaagagaattattttttgttatgtgacgttttaccagaagatagaattcttagagaagagcttcagaaacagagactgagagaaattctggaacaacagcagcaagaacgaaatgataccaattttcatggcgtttgtatgttttgcaatgaagaattccttggaaacagatctgttattttgaaccacatggccagagaacatgctttcaacattggattgccagacaacattgtaaactgcaatgaatttttgtgtacattacagaaaaagcttgacaatttgcagtgcttgtactgtgagaagaccttcagggacaaaaatacacttaaagatcacatgaggaaaaaacagcatcgtaagattaatcctaagaacagagaatatgacagattttatgtcatcaattatttggaacttggaaaatcgtgggaagaagttcagttggaagatgatcgggagttgctggaccatcaggaagatgactggtctgattgggaagaacaccctgcctctgcagtctgcttattttgtgaaaagcaagcagaaacaattgagaagttgtatgtccacatggaggatgcacacgaatttgatcttctcaaaataaagtcagaacttggattaaatttctatcagcaagtgaaactggtcaattttattcggaggcaagttcaccaatgcagatgttatggctgccatgtgaagttcaaatccaaagcagacttaagaactcacatggaagaaactaaacacacttcgctgctccccgatagaaagacgtgggatcaactggagtattattttccaacctatgaaaatgacactctcctgtgtacactatctgacagtgaaagtgacctgacagctcaggaacaaaatgaaaatgttcccatcatcagtgaagatacatctaaactgtatgctttgaaacaaagcagtattttgaaccagttgctactataagagtacttgaaaacctagaagaaactaccacagaagcaatttttcatgtttttctcctatgagacagatatgaaagaacaatttaaatttgaacatcaacaaaagattggtccttggtgaaataaacttttcaaaaatgaatgttcttttcaaaaaataaagtagaaaaatgcacttactaagaacatgaaaaaaaatgaagtaggaaaataagatgaagactttgtattttggctgtaaagttttattgtgtgatcatcttaaattatctcacttcattaaactcataattatatatagaagtatatgtcaattacaaagaaatgaaatgttcaaattatttataaacctgatttttcaatcagta

SEQ ID NO: 201989 - DNA, 1736 bp, Homo sapiens
  Payload ID: 19846
  Gene Name: zinc finger protein 277
  ENST ID: ENST00000361946
  CDS Start-End: 23-175
cccttttcttttctgccgggtaatggctgcttccaagacccagggggctgtcgcccgaatgcaggaagaccgtgatgggagctgcagcacagtcgggggtgtaggttatggggtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtacattttatattggaggaaaaggttcactgaacagcccatcacagatttttgtagtgtaataagaattaattccactgctccatttgaagaacaagagaattattttttgttatgtgacgttttaccagaagatagaattcttagagaagagcttcagaaacagagactgagagaaattctggaacaacagcagcaagaacgaaatgataccaattttcatggcgtttgtatgttttgcaatgaagaattccttggaaacagatctgttattttgaaccacatggccagagaacatgctttcaacattggattgccagacaacattgtaaactgcaatgaatttttgtgtacattacagaaaaagcttgacaatttgcagtgcttgtactgtgagaagaccttcagggacaaaaatacacttaaagatcacatgaggaaaaaacagcatcgtaagattaatcctaagaacagagaatatgacagattttatgtcatcaattatttggaacttggaaaatcgtgggaagaagttcagttggaagatgatcgggagttgctggaccatcaggaagatgactggtctgattgggaagaacaccctgcctctgcagtctgcttattttgtgaaaagcaagcagaaacaattgagaagttgtatgtccacatggaggatgcacacgaatttgatcttctcaaaataaagtcagaacttggattaaatttctatcagcaagtgaaactggtcaattttattcggaggcaagttcaccaatgcagatgttatggctgccatgtgaagttcaaatccaaagcagacttaagaactcacatggaagaaactaaacacacttcgctgctccccgatagaaagacgtgggatcaactggagtattattttccaacctatgaaaatgacactctcctgtgtacactatctgacagtgaaagtgacctgacagctcaggaacaaaatgaaaatgttcccatcatcagtgaagatacatctaaactgtatgctttgaaacaaagcagtattttgaaccagttgctactataagagtacttgaaaacctagaagaaactaccacagaagcaatttttcatgtttttctcctatgagacagatatgaaagaacaatttaaatttgaacatcaacaaaagattggtccttggtgaaataaacttttcaaaaatgaatgttcttttcaaaaaataaagtagaaaaatgcacttactaagaacatgaaaaaaaatgaagtaggaaaataagatgaagactttgtattttggctgtaaagttttattgtgtgatcatcttaaattatctcacttcattaaactcataattatatatagaagtatatgtcaattacaaagaaatgaaatgttcaaattatttataaacctgatttttcaatcag

SEQ ID NO: 201990 - DNA, 617 bp, Homo sapiens
  Payload ID: 19846
  Gene Name: zinc finger protein 277
  ENST ID: ENST00000425229
  CDS Start-End: 20-617
ttttcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaagatctgttattttgaaccacatggccagagaacatgctttcaacattggattgccagacaacattgtaaactgcaatgaatttttgtgtacattacagaaaaagcttgacaatttgcagtgcttgtactgtgagaagaccttcagggacaaaaatacacttaaagatcacatgaggaaaaaacagcatcgtaagattaatcctaagaacagagaatatgacagattttatgtcatcaattatttggaacttggaaaatcgtgggaagaagttcagttggaagatgatcgggagttgctggaccatc

SEQ ID NO: 201991 - DNA, 1075 bp, Homo sapiens
  Payload ID: 19846
  Gene Name: zinc finger protein 277
  ENST ID: ENST00000450657
  CDS Start-End: 17-889
tcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtacattttatattggaggaaaaggttcactgaacagcccatcacagatttttgtagtgtaataagaattaattccactgctccatttgaagaacaagagaattattttttgttatgtgacgttttaccagaagatagaattcttagagaagagcttcagaaacagagactgagagaaattctggaacaacagcagcaagaacgaaatgataccaattttcatggcgtttgtatgttttgcaatgaagaattccttggaaacagatctgttattttgaaccacatggccagagaacatgctttcaacattggattgccagacaacattgtaaactgcaatgaatttttgtgtacattacagaaaaagcttgacaatttgcagtgcttgtactgtgagaagaccttcagggacaaaaatacacttaaagatcacatgaggaaaaaacagcatcgtaagattaatcctaagaacagagaatatgacagattttatgtcatcaattatttggtaaggctttcttttcataacttaaaatttgattgcagtactgcaaacaaaatctttctgaggaccaactaatatttgaataagcaattattgcaaaagtcaaaatgtaattgaggggcacattcaagtagtgattagctttgaaatggttagagtacaagacatttgatttgacttgtcttttatttgacagtgtttatgtagtaaaaatgtcatgtctctagaactcacagtcatcttgaccaaaaaaaaaaaaaa

SEQ ID NO: 201992 - DNA, 891 bp, Homo sapiens
  Payload ID: 19846
  Gene Name: zinc finger protein 277
  ENST ID: ENST00000457808
  CDS Start-End: 21-344
cttttcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaagaagaacaagagaattattttttgttatgtgacgttttaccagaagatagaattcttagagaagagcttcagaaacagagactgagagaaattctggaacaacagcagcaagaacgaaatgataccaattttcatggcgtttgtatgttttgcaatgaagaattccttggaaacagatctgttattttgaaccacatggccagagaacatgctttcaacattggattgccagacaacattgtaaactgcaatgaatttttgtgtacattacagaaaaagcttgacaatttgcagtgcttgtactgtgagaagaccttcagggacaaaaatacacttaaagatcacatgaggaaaaaacagcatcgtaagattaatcctaagaacagagaatatgacagattttatgtcatcaattatttggaacttggaaaatcgtgggaagaagttcagttggaagatgatcgggagttgctggaccatcaggaagatgactggtctgattgggaagaacaccctgcctctgcagtctgcttattttgtgaaaagcaagcagaaacaattgagaagttgtatgtccac

SEQ ID NO: 201993 - DNA, 2218 bp, Homo sapiens
  Payload ID: 19846
  Gene Name: zinc finger protein 277
  ENST ID: ENST00000421043
  CDS Start-End: 21-317
cttttcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtaagttctgtttttgtccttaaaagaattaaatttgaccatgtgtggtggctcatgtctgtaatcctagtactttgggaggccaaagtgggaggatcacccgaggccagtagtagttcaagatgccagctctaaaaacaaaatttaaaaattatctaggatcaatggcatgcacctgtagttccagctacttgggaggttgaggcaggagggctgcttgcacccatgagttcgaggctgcagtgagttatggttataccattgcactccagcctgggtgacagaatgagaccctgtctcttaagaaagagaattaaatgtattgtttgttaaaggagtgacataatctatatataaaataattcccatacaaatatgaaaattcatattcattttcaggtttctccttagacttaaaaaaaaaaactttacaactcttttgtacttctgagactttttttttttttttgagatggagttttgctattgtcacccaggctggagtgcagtggcacgatctcagcttgttgcaacttctgcctcccatgttcaagcgattctcctgcctcagcctcctgagtagctgggattacaggcacctgccaccacgcccagctaatttttgtattcttagtagagatggggtttcaccatgttggccaggcctgtctcgaactcctgagctcaggtgatctgcccacctcagcctcccacagtgctgggattacaggcatgagccactgcacccagccaacttctcagactttaaaaaaatctttacattatttttcttgagtctgtaagtttgagaatgtcacatactaatttattttctataagttctctaaagagatgaactttccaaagagtagataatactcactttgcagcattccatgacattgtagatcttattgatgtctcccagattatgtctcatgttttaggccatagacattctctgagtgggtccttccagtaattccagaatagacttggcaacaggacactcaaaaggcagtgtttgggaatgggatccttggagactttcaagccaaaaggatattgcccaaacaaatctcagtttaaatgttgtgatgaggttgattccttttttcccaatttataatttctggaagtagttgtccaagagaaataccttccctgtatagttactgaaagcataaaatttggtgtatctggtaaggtcccattttgaggtattctgtcctgatttccccataaaacattgtagtagcccagacattgaatacccctgcatctaaactctgtttctcccaggccatataaaacattcctagcaaacagcttctttcttatgataggtcttgcaaaagagcaagctgtattattaagagctgactatgaaagtaggaaagcctggggttgagtgcaggctttcacacttcctaatcttgtgatttcctgccaagctacctaactactctaagcattgattttctcatctataaaatgggggtaacaccagccctcatggttattgaatattacataaaacaaagtatggaatgtgagggcgatctggctgtgacatctgtcaccccattaatcgccagggttgattcggctgatctggctggctaagtggctgtccccttcctccctcaccactccatgttcatgcctcccaaagctgtgttctcagtcaaagaggacaaccatctccactagaagaggaccagtctttggtcaagggtatacgagtagctgcgcttccctgctggaacctccagacaagctctcaagtccatttgtaggagaacatagggtagtcaagcttccaagattccagacacatccaaatgaagtgctgcatgtggcagtctgcctttcttaaaaaaaaaaaaaaaaaaaaaaaaaaaa

SEQ ID NO: 201994 - DNA, 651 bp, Homo sapiens
  Payload ID: 19846
  Gene Name: zinc finger protein 277
  ENST ID: ENST00000421864
  CDS Start-End: 1-357
agtgactggtctgattgggaagaacaccctgcctctgcagtctgcttattttgtgaaaagcaagcagaaacaattgagaagttgtatgtccacatggaggatgcacacgaatttgatcttctcaaaataaagtcagaacttggattaaatttctatcagcaagtgaaactggtcaattttattcggaggtattattttccaacctatgaaaatgacactctcctgtgtacactatctgacagtgaaagtgacctgacagctcaggaacaaaatgaaaatgttcccatcatcagtgaagatacatctaaactgtatgctttgaaacaaagcagtattttgaaccagttgctactataagagtacttgaaaacctagaagaaactaccacagaagcaatttttcatgtttttctcctatgagacagatatgaaagaacaatttaaatttgaacatcaacaaaagattggtccttggtgaaataaacttttcaaaaatgaatgttcttttcaaaaaataaagtagaaaaatgcacttactaagaacatgaaaaaaaatgaagtaggaaaataagatgaagactttgtattttggctgtaaagttttattgtgtgatcatcttaaattatctcacttcattaaactcataattat

SEQ ID NO: 201995 - DNA, 650 bp, Homo sapiens
  Payload ID: 19847
  Gene Name: zinc finger protein 28
  ENST ID: ENST00000339844
  CDS Start-End: 295-534
ctatatatgcaaaccctttgggatggccactaaatttgtcacagagtatggtaacgtggttgactgaaccacagccatgaaagtgagcttccagctcttctgctgttgcaccgcagtccacattgccagcattgatggaacgggcatcagcctccatcttctcctcaatggacgtgatcactgggccagcattgcctggagggtctattgacattcagggacgtggccatagaattctctcaggaggagtggaaatgcctggaccctgctcagaggactctttacagggatgtgatgctggagaattataggaacctggtctccctggattttcggtctgtcacccaggctaaagtgcagtggtgtcacctcggctcactgcaacctccacttcccaggttcaagcaattctcctgcctcagccttccaagtagctgggactacagggcaaggcaatacagaagcgttccacacagggacattgcaaagacaagcaagtcatcacattggagatttttgcttccagaaaattgagaaagacattcatggcttccagtttcagtggaaagaagatgaaacaaatgaccatgcagcacccatgacagaaatcaaagagttgactggtagtacaggccaacatgatcaaaggc

SEQ ID NO: 201996 - DNA, 1827 bp, Homo sapiens
  Payload ID: 19847
  Gene Name: zinc finger protein 28
  ENST ID: ENST00000391783
  CDS Start-End: 190-1827
aggcctggtttctgtcctgcgcgcgcagattcgcgcagaccaggaagcggatcccgtggaatgacggtgacgccgcggcgggcggattgacttctaaagaatcttggtacgtgaggaagaaacccagaagaggaagaggaaagcaaaggagtcagggatggctcttcctcagatatctcttccaaatgcatgatgaagacattcttctcaacagggcaaggcaatacagaagcgttccacacagggacattgcaaagacaagcaagtcatcacattggagatttttgcttccagaaaattgagaaagacattcatggcttccagtttcagtggaaagaagatgaaacaaatgaccatgcagcacccatgacagaaatcaaagagttgactggtagtacaggccaacatgatcaaaggcatgctggaaacaagcatattaaagatcagcttggattaagctttcattcgcatctgcctgaactgcacatatttcagcctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaacggaatgtacacatgagagaaaaatctttccaatgtattgagagtggcaaatcctttaattgtagctcacttttaaaaaaacatcagataacccacttagaagagaaacaatgtaaatgtgatgtatatggcaaggtatttaatcagaagcgataccttgcatgccatcgtagatctcacattgatgagaaaccttacaagtgtaatgagtgtggcaagatctttggtcacaatacatccctcttccttcacaaggcgcttcatactgcagacaaaccttatgaatgtgaagaatgtgacaaagttttcagtcgcaaatcacaccttgaaacacataagataatttatactggagggaaaccatacaaatgtaaggtttgtgacaaagctttcacatgtaattcatacctagcaaaacatactataattcacactggagagaaaccttacaagtgtaatgaatgtggcaaggtttttaatcgactgtcaacccttgcacgccatcgtaggcttcatactggagagaaaccttatgaatgtgaagaatgtgaaaaagttttcagtcgcaaatcacatcttgaaagacataagaggattcatactggagagaaaccatacaaatgtaaggtttgtgacaaggcttttgcatataattcatacctggcaaaacatagtataattcacactggagagaagccttacaagtgtaatgaatgtggcaaggtttttaatcaacaatcaactcttgcacgccatcatagacttcatactgcagagaaaccatacaaatgtgaagaatgtgacaaagttttcaggtgcaaatcacaccttgaaagacataggaggattcatactggagagaaaccatacaaatgtaaggtttgtgacaaggctttccggagtgattcatgccttacagaacatcagagagttcatactggagagaaaccatacatgtgtaatgaatgtggcaaggtttttagtacaaaagcaaaccttgcatgtcatcataaacttcatactgcagagaaaccgtacaaatgtgaagaatgtgagaaagttttcagtcgcaaatcacacatggaaagacataggaggattcatactggagagaaaccgtacaaatgtaaggtttgtgacaaggctttccggagggattcacacctggcacaacatcagaga

SEQ ID NO: 201997 - DNA, 4556 bp, Homo sapiens
  Payload ID: 19847
  Gene Name: zinc finger protein 28
  Uniprot ID: P17035
  ENST ID: ENST00000457749
  CDS Start-End: 121-2277
gaccaggaagcggatcccgtggaatgacggtgacgccgcggcgggcggattgacttctaaagaatcttggtacgtgaggaagaaacccagaagaggaagaggaaagcaaaggagtcagggatggctcttcctcagggtctattgacattcagggacgtggccatagaattctctcaggaggagtggaaatgcctggaccctgctcagaggactctttacagggatgtgatgctggagaattataggaacctggtctccctggatatctcttccaaatgcatgatgaagacattcttctcaacagggcaaggcaatacagaagcgttccacacagggacattgcaaagacaagcaagtcatcacattggagatttttgcttccagaaaattgagaaagacattcatggcttccagtttcagtggaaagaagatgaaacaaatgaccatgcagcacccatgacagaaatcaaagagttgactggtagtacaggccaacatgatcaaaggcatgctggaaacaagcatattaaagatcagcttggattaagctttcattcgcatctgcctgaactgcacatatttcagcctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaacggaatgtacacatgagagaaaaatctttccaatgtattgagagtggcaaatcctttaattgtagctcacttttaaaaaaacatcagataacccacttagaagagaaacaatgtaaatgtgatgtatatggcaaggtatttaatcagaagcgataccttgcatgccatcgtagatctcacattgatgagaaaccttacaagtgtaatgagtgtggcaagatctttggtcacaatacatccctcttccttcacaaggcgcttcatactgcagacaaaccttatgaatgtgaagaatgtgacaaagttttcagtcgcaaatcacaccttgaaacacataagataatttatactggagggaaaccatacaaatgtaaggtttgtgacaaagctttcacatgtaattcatacctagcaaaacatactataattcacactggagagaaaccttacaagtgtaatgaatgtggcaaggtttttaatcgactgtcaacccttgcacgccatcgtaggcttcatactggagagaaaccttatgaatgtgaagaatgtgaaaaagttttcagtcgcaaatcacatcttgaaagacataagaggattcatactggagagaaaccatacaaatgtaaggtttgtgacaaggcttttgcatataattcatacctggcaaaacatagtataattcacactggagagaagccttacaagtgtaatgaatgtggcaaggtttttaatcaacaatcaactcttgcacgccatcatagacttcatactgcagagaaaccatacaaatgtgaagaatgtgacaaagttttcaggtgcaaatcacaccttgaaagacataggaggattcatactggagagaaaccatacaaatgtaaggtttgtgacaaggctttccggagtgattcatgccttacagaacatcagagagttcatactggagagaaaccatacatgtgtaatgaatgtggcaaggtttttagtacaaaagcaaaccttgcatgtcatcataaacttcatactgcagagaaaccgtacaaatgtgaagaatgtgagaaagttttcagtcgcaaatcacacatggaaagacataggaggattcatactggagagaaaccgtacaaatgtaaggtttgtgacaaggctttccggagggattcacacctggcacaacatcagagagttcatactggagagaaaccttacaagtgtaatgagtgtggcaagaccttccgtcagacatcatcgcttataatccatcgtaggcttcatactggagagaaaccttacaagtgtaatgagtgtggcaagaccttcagtcagatgtcatccctcgtataccatcataggcttcatagtggagagaaaccttacaagtgtaatgaatgtggcaaggtttttaatcaacaagcacaccttgcacagcatcagagagttcatactggagagaaaccttacaagtgtaatgagtgtggcaagaccttcagtcagatgtcaaaccttgtataccatcatagacttcatagtggagagaaaccttgaaagtgtaatgagtgtggcaagaccttcagtcagatgtcaaaccttgtataccatcatagacttcatagtggagagaaaccttaaaagtgtaatgagtgtggcaacaccttccatcacaattcaacccttgtaagtcacaaagccattcatactggagagaaactttacaagtgtaatgaatgtggcaaggtttttaatcaaaaaacaacccttgcacgtcatcatagaattcatactgcagagaaactttacaaataggaagaatgtgacaaagttttcggttgcaaatcaaaccttgaaacacataagaaaatgcatgctgaagagaaaccacacagatgtaaggtttatgacaagatttttgaatataattcatacctggcaaaacatattagaattcaaactggagagaaaccttacaaatgtgatgagtgtggcaacacctttggtcaaaattcataccttgtaattcaaaaggcaattcgtattggagagaaaccctacaagtgtaatgaatgtggcatagtttttaatcaacagtcacaccttgcaagtcatcatagtcttcatactgcagagaaatcttacaaatgtgaagactgtgacaaagttgtcagtcacaaatcacagcttgaaagacaggagaattcatactggagaaaaaacatacaaatgtaaggtttgtaacaaggcttttgggagtgattcacacctggcacaccatactagaattcacactggagagaaaccttacaagtgcaatgagtgtggcaaagcctttagtgggcagtcaccacttattcaccatcaagcaatccatagtatagggaaacttgactaatataatgattgtcacaaagttttcagtaatgctacaaccattgcaaatcattggagaatccataatgagagatcttacaagtgtaataaatgtgacagatttttcagatatcgttcatatattgctattcatcatcgaactcatgctggagagaaaccttataaatgtcatgattgtggcaaggtcttcagtcaagtttcatcctatgcaaaacataggaggattcatacaggagagaaactcacaagtgtgatgattgtggcaaagcgtttacttcacattcacacctcaatagacatcagagaatccatgctggacagaaatcttacaaatgtcatcagtgtggtaaggtcttcagtccgagatcactccttgcagaccatcagacaattccttttggagacagttgtttcaaatgccattagtatagcaagccatcaagcattaattgacattacagttaaatgagcactgacctgagtttgagttgacttaacattgagtttaagcattaattgacattaaactgtttatgttaagaggactgggctgggcactgtggctcacgcctgcaatgccagcactttgagaggccaagactggtaggtcactggaggttaagagtttgagaacagcctggccaacagacgggagccacttttcccagcctgtgttttcatttctattctttctttcttttttcttttttttgtttttgtttttgagatggagtctcttgctctgtcatccaggttggagtgcagtggcatgatcttgactcactacaacctccgcctcccaggttcaagcgatcctcctgcctcagtctcctgactagctgggactacaggtgcatgccaccacacctggataattttttgtatttttagtagagactgggtttcgctgtgttagcctggatggtctcgattttctgatcttatgattcacccacctctacctcccgaagtgctgagattatgggcgtgagccaccgtgactggcctgttttttgtttctttaacaaaaagttatggggatttctatgagtattgtgttgaatctaaatcacattcggttatataatcattgagcaatactaatttttccaatcagtatggattgtatgtgtatttatatgtttttaatcattttgatcaatgtttgtagatttcaaggtacaaacttctcacctttatatgtttattcctaaatatttcttactttaagctctttagcaaatggaagtggtttttaattttattttaaaattatttaatgttaatgtatggaaattcaactaatttttggtgctattattctattctgcaaatacactgaatatgtttattagttccagttgtattttggttgactgtgattttcttcacagatcatgtcatctacaaacaaataaaatttgacttctttctttctg

SEQ ID NO: 201998 - DNA, 5171 bp, Homo sapiens
  Payload ID: 19847
  Gene Name: zinc finger protein 28
  Uniprot ID: P17035
  ENST ID: ENST00000438150
  CDS Start-End: 895-2892
tgtatctgtccttttattaattaattactttatgtatttatgagactgagttttgctgttgtcacccaggctgaagtacgatgctgcgatctcagctcactgcaacctctgcctctcgggtacaaccgattctcctgcctcaggcccctgagaagctgggattacagatatgcaccaccacacccatctaattttgtatttttagtagagactgtttctttttgttggccaggctggactcgaactcctgacctcaggtgatctgcccagctcatcctcccaaagtgttgggattacaggcatgaaccacgatgcttggcctatctgtttttactacctttactggagaactttatttatttatttatttatttatttttattattattatttttgagatggagtctcactctgtcgcccaggccggagtgcagtggtgtgatctctgctcactgcaacctccaccttctgggttcaagcaattctccttcctcagcctcccgagtagctgcaactacaagtgtgcaccactacacccagctaagttttgtatttttagtagagatggggttccaccatgttggttggccaggatagtctcaatctcctgacctggtgatctgccagcctcagcctcccaaagtgctgggattattggcgtgaaccaccacaccaggcctggagaactttatatatgcttgtgggttggagttactctttagccttctttcatttcttttttttttttctttgagacagattttcggtctgtcacccaggctaaagtgcagtggtgtcacctcggctcactgcaacctccacttcccaggttcaagcaattctcctgcctcagccttccaagtagctgggactacagatatctcttccaaatgcatgatgaagacattcttctcaacagggcaaggcaatacagaagcgttccacacagggacattgcaaagacaagcaagtcatcacattggagatttttgcttccagaaaattgagaaagacattcatggcttccagtttcagtggaaagaagatgaaacaaatgaccatgcagcacccatgacagaaatcaaagagttgactggtagtacaggccaacatgatcaaaggcatgctggaaacaagcatattaaagatcagcttggattaagctttcattcgcatctgcctgaactgcacatatttcagcctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaacggaatgtacacatgagagaaaaatctttccaatgtattgagagtggcaaatcctttaattgtagctcacttttaaaaaaacatcagataacccacttagaagagaaacaatgtaaatgtgatgtatatggcaaggtatttaatcagaagcgataccttgcatgccatcgtagatctcacattgatgagaaaccttacaagtgtaatgagtgtggcaagatctttggtcacaatacatccctcttccttcacaaggcgcttcatactgcagacaaaccttatgaatgtgaagaatgtgacaaagttttcagtcgcaaatcacaccttgaaacacataagataatttatactggagggaaaccatacaaatgtaaggtttgtgacaaagctttcacatgtaattcatacctagcaaaacatactataattcacactggagagaaaccttacaagtgtaatgaatgtggcaaggtttttaatcgactgtcaacccttgcacgccatcgtaggcttcatactggagagaaaccttatgaatgtgaagaatgtgaaaaagttttcagtcgcaaatcacatcttgaaagacataagaggattcatactggagagaaaccatacaaatgtaaggtttgtgacaaggcttttgcatataattcatacctggcaaaacatagtataattcacactggagagaagccttacaagtgtaatgaatgtggcaaggtttttaatcaacaatcaactcttgcacgccatcatagacttcatactgcagagaaaccatacaaatgtgaagaatgtgacaaagttttcaggtgcaaatcacaccttgaaagacataggaggattcatactggagagaaaccatacaaatgtaaggtttgtgacaaggctttccggagtgattcatgccttacagaacatcagagagttcatactggagagaaaccatacatgtgtaatgaatgtggcaaggtttttagtacaaaagcaaaccttgcatgtcatcataaacttcatactgcagagaaaccgtacaaatgtgaagaatgtgagaaagttttcagtcgcaaatcacacatggaaagacataggaggattcatactggagagaaaccgtacaaatgtaaggtttgtgacaaggctttccggagggattcacacctggcacaacatcagagagttcatactggagagaaaccttacaagtgtaatgagtgtggcaagaccttccgtcagacatcatcgcttataatccatcgtaggcttcatactggagagaaaccttacaagtgtaatgagtgtggcaagaccttcagtcagatgtcatccctcgtataccatcataggcttcatagtggagagaaaccttacaagtgtaatgaatgtggcaaggtttttaatcaacaagcacaccttgcacagcatcagagagttcatactggagagaaaccttacaagtgtaatgagtgtggcaagaccttcagtcagatgtcaaaccttgtataccatcatagacttcatagtggagagaaaccttgaaagtgtaatgagtgtggcaagaccttcagtcagatgtcaaaccttgtataccatcatagacttcatagtggagagaaaccttaaaagtgtaatgagtgtggcaacaccttccatcacaattcaacccttgtaagtcacaaagccattcatactggagagaaactttacaagtgtaatgaatgtggcaaggtttttaatcaaaaaacaacccttgcacgtcatcatagaattcatactgcagagaaactttacaaataggaagaatgtgacaaagttttcggttgcaaatcaaaccttgaaacacataagaaaatgcatgctgaagagaaaccacacagatgtaaggtttatgacaagatttttgaatataattcatacctggcaaaacatattagaattcaaactggagagaaaccttacaaatgtgatgagtgtggcaacacctttggtcaaaattcataccttgtaattcaaaaggcaattcgtattggagagaaaccctacaagtgtaatgaatgtggcatagtttttaatcaacagtcacaccttgcaagtcatcatagtcttcatactgcagagaaatcttacaaatgtgaagactgtgacaaagttgtcagtcacaaatcacagcttgaaagacaggagaattcatactggagaaaaaacatacaaatgtaaggtttgtaacaaggcttttgggagtgattcacacctggcacaccatactagaattcacactggagagaaaccttacaagtgcaatgagtgtggcaaagcctttagtgggcagtcaccacttattcaccatcaagcaatccatagtatagggaaacttgactaatataatgattgtcacaaagttttcagtaatgctacaaccattgcaaatcattggagaatccataatgagagatcttacaagtgtaataaatgtgacagatttttcagatatcgttcatatattgctattcatcatcgaactcatgctggagagaaaccttataaatgtcatgattgtggcaaggtcttcagtcaagtttcatcctatgcaaaacataggaggattcatacaggagagaaactcacaagtgtgatgattgtggcaaagcgtttacttcacattcacacctcaatagacatcagagaatccatgctggacagaaatcttacaaatgtcatcagtgtggtaaggtcttcagtccgagatcactccttgcagaccatcagacaattccttttggagacagttgtttcaaatgccattagtatagcaagccatcaagcattaattgacattacagttaaatgagcactgacctgagtttgagttgacttaacattgagtttaagcattaattgacattaaactgtttatgttaagaggactgggctgggcactgtggctcacgcctgcaatgccagcactttgagaggccaagactggtaggtcactggaggttaagagtttgagaacagcctggccaacagacgggagccacttttcccagcctgtgttttcatttctattctttctttcttttttcttttttttgtttttgtttttgagatggagtctcttgctctgtcatccaggttggagtgcagtggcatgatcttgactcactacaacctccgcctcccaggttcaagcgatcctcctgcctcagtctcctgactagctgggactacaggtgcatgccaccacacctggataattttttgtatttttagtagagactgggtttcgctgtgttagcctggatggtctcgattttctgatcttatgattcacccacctctacctcccgaagtgctgagattatgggcgtgagccaccgtgactggcctgttttttgtttctttaacaaaaagttatggggatttctatgagtattgtgttgaatctaaatcacattcggttatataatcattgagcaatactaatttttccaatcagtatggattgtatgtgtatttatatgtttttaatcattttgatcaatgtttgtagatttcaaggtacaaacttctcacctttatatgtttattcctaaatatttcttactttaagctctttagcaaatggaagtggtttttaattttattttaaaattatttaatgttaatgtatggaaattcaactaatttttggtgctattattctattctgcaaatacactgaatatgtttattagttccagttgtattttggttgactgtgattttcttcacagatcatgtcatctacaaacaaataaaatttgacttctttctttctg

SEQ ID NO: 201999 - DNA, 684 bp, Homo sapiens
  Payload ID: 19847
  Gene Name: zinc finger protein 28
  ENST ID: ENST00000594602
  CDS Start-End: 103-492
gtggaatgacggtcacgccgcggcgggcggattgacttctaaagaatcttggtacgtgaggaagaaacccagaagaggaagaggaaagcaaaggagtcagggatggctcttcctcagggtctattgacattcagggacgtggccatagaattctctcaggaggagtggaaatgcctggaccctgctcagaggactctttacagggatgtgatgctggagaattataggaacctggtctccctggattttcggtctgtcacccaggctaaagtgcagtggtgtcacctcggctcactgcaacctccacttcccaggttcaagcaattctcctgcctcagccttccaagtagctgggactacagatatctcttccaaatgcatgatgaagacattcttctcaacagggcaaggcaatacagaagcgttccacacagggacattgcaaagacaagcaagtcatcacattggagatttttgcttccagaaaattgagaaagacattcatggcttccagtttcagtggaaagaagatgaaacaaatgaccatgcagcacccatgacagaaatcaaagagttgactggtagtacaggccaacatgatcaaaggcatgctggaaacaagcatattaaagatcagcttggattaagctttcattcgcatctgcctgaactgcacatatttca

SEQ ID NO: 202000 - DNA, 628 bp, Homo sapiens
  Payload ID: 19847
  Gene Name: zinc finger protein 28
  ENST ID: ENST00000596559
  CDS Start-End: 103-628
gtggaatgacggtcacgccgcggcgggcggattgacttctaaagaatcttggtacgtgaggaagaaacccagaagaggaagaggaaagcaaaggagtcagggatggctcttcctcagattttcggtctgtcacccaggctaaagtgcagtggtgtcacctcggctcactgcaacctccacttcccaggttcaagcaattctcctgcctcagccttccaagtagctgggactacagatatctcttccaaatgcatgatgaagacattcttctcaacagggcaaggcaatacagaagcgttccacacagggacattgcaaagacaagcaagtcatcacattggagatttttgcttccagaaaattgagaaagacattcatggcttccagtttcagtggaaagaagatgaaacaaatgaccatgcagcacccatgacagaaatcaaagagttgactggtagtacaggccaacatgatcaaaggcatgctggaaacaagcatattaaagatcagcttggattaagctttcattcgcatctgcctgaactgcacatatttcagcctgaagggaaaattggtaatcaagttgagaagtctatcaacaatgcttcctcagtttcaacatcccaaa

SEQ ID NO: 202001 - DNA, 2148 bp, Homo sapiens
  Payload ID: 19848
  Gene Name: zinc finger protein 280A
  Uniprot ID: P59817
  ENST ID: ENST00000302097
  CDS Start-End: 254-1882
agaaaggactttgaagagcaagcggcgttgttcgcctgcggaagcagtgctgccggtctctggacaaatttctccgggaggtggagacaaggaagctccagcttcgctttcccttgcggcccagagtggaacatactgagctgcactgaatcatctggatgcactcgcaactttaggaactggtggcaatttgtaaaaagacagctctggaagttgaagagaccagtggcttcaagcaaaaagtaaattgaaaatgggagatatctttttgtgtaagaaagtggaatcaccaaagaagaatttgagagaatccaaacaaagggaggaggatgatgaagatccagatctgatctatgttggggtggagcatgtacatagagatgctgaagttctctttgtcgggatgatttcaaattcaaaaccagtcgtttcaaacattttgaacagagtcaccccaggctcaaattcaagaagaaagaaaggccacttccgtcaatatcctgctcacgtgtcgcagcctgcaaatcatgtgacctctatggcaaaagccatcatgccggtttctctgtctgaggggcgatcgacagatagtcctgtcactatgaagtcttcatctgaacctggttataaaatgagctcaccacaagttgtttctcccagttcctcagactcgctccccccagggactcagtgtctagttggagctatggtctctggaggaggcagaaatgagagttctcctgattcaaagcgactttccacttcagatataaacagcagagattccaaaagggttaaactcagggatggaatcccaggggtaccttctttagctgtggtcccttcagatatgtcttctacaataagcacaaatacaccctcacaggggatctgcaactcatcaaaccatgttcagaatggagtaacatttccttggcctgatgctaatggaaaggcacatttcaatcttacagatccagagagagcaagtgagtctgccctggcaatgacagacatttcaagtctagcaagtcaaaacaagacctttgatcccaagaaagaaaatcccatcgtgttacttagcgacttttactatggacagcataaaggagatgggcagccggaacagaagactcacaccacctttaaatgcctcagctgcgtgaaagttctaaaaaatattaagtttatgaatcacatgaagcatcatttggaatttgagaagcagaggaacgacagctgggaagaccacaccacctgccagcactgccaccggcagtttcccactcccttccagctacagtgtcacattgatagtgtacacatcgccatggggccctctgctgtctgtaaaatctgtgaattgtcatttgaaacagatcaggtcctcttacaacacatgaaggaccatcataagcctggcgaaatgccttatgtgtgccaggtttgccattacagatcgtcggtctttgctgatgtggaaacacattttagaacgtgccatgaaaacacaaagaatttgctttgtctgttttgtctcaaacttttcaaaactgcaataccatacatgaatcattgttggaggcacagcagaaggagggtccttcagtgttccaagtgccggctacagtttttgacgttgaaggaggaaatagagcacaaaaccaaggaccatcaaacatttaaaaagccggagcaactgcaagggttgcctagtgaaacaaaagttattattcaaacttcagttcagccaggatcaagtggtatggcttccgttattgttagcaacactgaccctcagtcttctcctgtaaaaactaaaaagaagacggctatgaacactagagattccagactcccttgcagcaaggattctagctgaaaatatgttcgactgacttccaggagttccgaaaggcagaagtgaggctaggccatatgtgcattgtggctgtagatgctagcaagcaatgtcatcaactgtcaggttgttttttacagtgacatctcatcagctccctattgtcaagaagtagctccaaagtctttgagccctttcccagtcaaatgctcccaacagggcatcccttattctgacctcagaggtttttcttgttcatgaactttaaataaatggaatcacacaaa

SEQ ID NO: 202002 - DNA, 2148 bp, Homo sapiens; identical to SEQ ID NO: 202001
  Payload ID: 19848
  Gene Name: zinc finger protein 280A
  ENST ID: ENST00000620282
  CDS Start-End: 254-1882

SEQ ID NO: 202003 - DNA, 3714 bp, Homo sapiens
  Payload ID: 19849
  Gene Name: zinc finger protein 280B
  ENST ID: ENST00000616997
  CDS Start-End: 71-1702
aggtggcagtttatataaaggaagcattgggacttgtggccccaccattcaggaataaaaaaattagaaaatggaacaatcatgtgaggaagagaaagagcctgaaccacagaagaacatacaagaaaccaaacaagtagatgacgaagatgctgagctcatctttgttggtgtggaacatgtaaatgaagatgctgagctaatctttgttggggtgacttcaaattcaaaaccagtcgtttcaaacattttgaacagagtcaccccgggttcatggtcaaggagaaaaaagtatgatcaccttagaaaagatactgctcgcaaattgcagcctaaaagtcatgagaccgttacatcagaagcagtgaccgtcctgccagcttcccaacttgaatcgagatcaacagatagtcctattattattgagcctttgtctaaacctgattatagaaatagttcaccacaagttgtgcctaataactcttcagaattaccttctcctttgattacattcacagattcattgcatcatccagtaagtacagcactttcagtaggaggtataaatgaaagtcctcgtgtatcaaagcaactttccactttcgaagtaaacagcataaatcccaaaagggctaaactcagggatggaattatagaaggaaattcttcagcttcattcccttcagatacctttcatacaatgaatactcagcaaagtacaccctcaaataatgttcatacctcattaagccatgttcagaatggagcaccttttccagcagcttttccaaaggacaatatccatttcaagcctataaatacaaatcttgatagggcaaatgaattggcaaaaacagacattttgagtctaacaagtcaaaacaagacctttgatcccaagaaagaaaatcccattgtgttacttagtgacttttactatggacagcataaaggagaagggcagccggaacagaagactcacaccacctttaaatgcctcagctgcgtgaaagttctaaaaaatgttaagtttatgaatcacgtgaagcatcatttggaatttgagaagcagaggaacgacagctgggaaaaccacaccacctgccagcactgccaccggcagtttcccactcccttccagctacagtgtcacatcgaaaatgtccacactgcccaggagccctctactgtctgtaaaatctgtgaattgtcatttgaaacagatcaggtcctcttacaacacatgaaggaccatcataagcctggcgaaatgccctatgtgtgccaggtttgccattatagatcgtcggtctttgctgatgtagaaacacattttagaacgtgccatgaaaacacaaagaatttgctttgtcccttttgtctcaaaattttcaaaacagcaacaccatacatgtgtcattataggggccactggggaaagagtgcacaccagtgttccaagtgccggctacagtttttaactttcaaggagaaaatggagcacaagacccagtgtcatcaaatgtttaagaagcctaagcaactagaaggattacctcctgaaacaaaagttactattcaagtgtcgctggaacctcttcagccaggatcagtggatgtagcatccataactgtgagcacatctgactctgaaccatcactccccaggtctaaaagcaaaatttcaaaaaagtcccattaattctagtttcagtaaatctaaagcaagtatttcaaaccaaattaaaaaacctcataaaacaaaaaatacaaaccatacattattcagtagcaccaaaaatagtgaaactagtggattatatatgactttttaaacaagattcaggatatatattatttgatctgaattttgaggtattattttaaaacatctggttttcatgttaactgtatctggcttaacacataaaaggtgtttgtgtgtgtgtgtgagagagagaaaaaggtattaatttatttttttaattttaatttttttttttttttttttttttttttttactttagagacagggtctcactgttacccaggctggagtgcagtggcgtgatcctagctcactgcaaccttgaacttccaggctcaagcattcctccgcctcagcctttggagagtagctaggactacaggcgcagccaccacacccagctaattttttattttaattttttgtagcgatggaatcttgttatgtcgcccagggtggtctcgaactcctgaccttaggggagcctcctgcctcagcctccccaagtgctgggttgtgtgagtcactgcccctggcacctatttattgttttggtatttcatgttactcctaagcttgaaagctcttttttctatatacagaattcatagaatttttgaaatacttagttttctttacagctttttccatgcattcagcatttcatggttaactctagtcagactggaatggctttgttatgccctggcccacttgctgccgaattcccagaagtgcctctgctgtgctggcataaaataacctgaaaagattctgaaaagccaggatgtggaattgaaagagaagctgctgcgtgagcagagaccaagaaggcggaggggctgtttcacagtattctggagtaccttttgagtattggttcctgaacatcagcagtcttggctgcctctgtggactcccggagttgtctccctgcttgtgttctggtgccatcctttgttcctccacccctgaccaaggtgcccagcagcctgtcttcaccagtcaaggaatccgccatcttggctgtagacatacataggtctggagaaatctctccctttttccttgatttctttttaaaggtaccttatctctccccactcctttcttccctcctcaatctagttaaatttcctaagctttcacaaaaatccgggaagagataattaagagcttagcatccctcttagagtagaaggcagtacagataacaaagaagttgtgagtatattatctacattttagaaaattttctgactctagatccatagattctgttgtatttatttgccggacactcatttgattgatttgcaccttgaacactatactaggtcttttcagttacgttgcttgggttaagacactttgctaaaattacagcctgaatcctttctttagttgaagaaagggtatgtgtgtgcaagtgggtgtgtgtgtgccagtttttcttgtctcaggtagatactcccactgtgtataaatagatctacagacttttcatacttacctcccgtattctgtttctgtggtaaaaatatgaagtgttttagttgtatgttgagtgattggttggtattatcaacactgttgtttgcagtctcattaaagcatgctcttaaggagtacatatggtcattaattgccaactgtagattccagtgatctggcccctgcctacctccttcctctctttttcattctctgtcatgcttctccactgttttccccaatgatgcactattttgacacactggccttgctattccttaagcaaatcacattcttcccaatccaaagactttgcacatgctgttgtctttcttagaatgcccttcccctaggcctgcatggcttgctacctcacttaattgtttgacacttcctttggttcattgagcttcaaggctcttaaaatgccactgacaatgagatctccctt

SEQ ID NO: 202004 - DNA, 3981 bp, Homo sapiens
  Payload ID: 19849
  Gene Name: zinc finger protein 280B
  Uniprot ID: Q86YH2
  ENST ID: ENST00000619852
  CDS Start-End: 323-1954
gccggctgtgccccgggagcgcctccggggctggtgcgtggccggcagctcgcgaacagcagctgatccggactggatgtgaccttctgcctggaatagctcaagttcttaaaagttgcgttgtaataaacctgaggctgggaagttcaagatcaagatgctggacgatttggttccttagtgaaggctctcttcctggctggtggatgacagccttcttgctgtgttctcacatgacagaaagaggaagcaaggtggcagtttatataaaggaagcattgggacttgtggccccaccattcaggaataaaaaaattagaaaatggaacaatcatgtgaggaagagaaagagcctgaaccacagaagaacatacaagaaaccaaacaagtagatgacgaagatgctgagctcatctttgttggtgtggaacatgtaaatgaagatgctgagctaatctttgttggggtgacttcaaattcaaaaccagtcgtttcaaacattttgaacagagtcaccccgggttcatggtcaaggagaaaaaagtatgatcaccttagaaaagatactgctcgcaaattgcagcctaaaagtcatgagaccgttacatcagaagcagtgaccgtcctgccagcttcccaacttgaatcgagatcaacagatagtcctattattattgagcctttgtctaaacctgattatagaaatagttcaccacaagttgtgcctaataactcttcagaattaccttctcctttgattacattcacagattcattgcatcatccagtaagtacagcactttcagtaggaggtataaatgaaagtcctcgtgtatcaaagcaactttccactttcgaagtaaacagcataaatcccaaaagggctaaactcagggatggaattatagaaggaaattcttcagcttcattcccttcagatacctttcatacaatgaatactcagcaaagtacaccctcaaataatgttcatacctcattaagccatgttcagaatggagcaccttttccagcagcttttccaaaggacaatatccatttcaagcctataaatacaaatcttgatagggcaaatgaattggcaaaaacagacattttgagtctaacaagtcaaaacaagacctttgatcccaagaaagaaaatcccattgtgttacttagtgacttttactatggacagcataaaggagaagggcagccggaacagaagactcacaccacctttaaatgcctcagctgcgtgaaagttctaaaaaatgttaagtttatgaatcacgtgaagcatcatttggaatttgagaagcagaggaacgacagctgggaaaaccacaccacctgccagcactgccaccggcagtttcccactcccttccagctacagtgtcacatcgaaaatgtccacactgcccaggagccctctactgtctgtaaaatctgtgaattgtcatttgaaacagatcaggtcctcttacaacacatgaaggaccatcataagcctggcgaaatgccctatgtgtgccaggtttgccattatagatcgtcggtctttgctgatgtagaaacacattttagaacgtgccatgaaaacacaaagaatttgctttgtcccttttgtctcaaaattttcaaaacagcaacaccatacatgtgtcattataggggccactggggaaagagtgcacaccagtgttccaagtgccggctacagtttttaactttcaaggagaaaatggagcacaagacccagtgtcatcaaatgtttaagaagcctaagcaactagaaggattacctcctgaaacaaaagttactattcaagtgtcgctggaacctcttcagccaggatcagtggatgtagcatccataactgtgagcacatctgactctgaaccatcactccccaggtctaaaagcaaaatttcaaaaaagtcccattaattctagtttcagtaaatctaaagcaagtatttcaaaccaaattaaaaaacctcataaaacaaaaaatacaaaccatacattattcagtagcaccaaaaatagtgaaactagtggattatatatgactttttaaacaagattcaggatatatattatttgatctgaattttgaggtattattttaaaacatctggttttcatgttaactgtatctggcttaacacataaaaggtgtttgtgtgtgtgtgtgagagagagaaaaaggtattaatttatttttttaattttaatttttttttttttttttttttttttttttactttagagacagggtctcactgttacccaggctggagtgcagtggcgtgatcctagctcactgcaaccttgaacttccaggctcaagcattcctccgcctcagcctttggagagtagctaggactacaggcgcagccaccacacccagctaattttttattttaattttttgtagcgatggaatcttgttatgtcgcccagggtggtctcgaactcctgaccttaggggagcctcctgcctcagcctccccaagtgctgggttgtgtgagtcactgcccctggcacctatttattgttttggtatttcatgttactcctaagcttgaaagctcttttttctatatacagaattcatagaatttttgaaatacttagttttctttacagctttttccatgcattcagcatttcatggttaactctagtcagactggaatggctttgttatgccctggcccacttgctgccgaattcccagaagtgcctctgctgtgctggcataaaataacctgaaaagattctgaaaagccaggatgtggaattgaaagagaagctgctgcgtgagcagagaccaagaaggcggaggggctgtttcacagtattctggagtaccttttgagtattggttcctgaacatcagcagtcttggctgcctctgtggactcccggagttgtctccctgcttgtgttctggtgccatcctttgttcctccacccctgaccaaggtgcccagcagcctgtcttcaccagtcaaggaatccgccatcttggctgtagacatacataggtctggagaaatctctccctttttccttgatttctttttaaaggtaccttatctctccccactcctttcttccctcctcaatctagttaaatttcctaagctttcacaaaaatccgggaagagataattaagagcttagcatccctcttagagtagaaggcagtacagataacaaagaagttgtgagtatattatctacattttagaaaattttctgactctagatccatagattctgttgtatttatttgccggacactcatttgattgatttgcaccttgaacactatactaggtcttttcagttacgttgcttgggttaagacactttgctaaaattacagcctgaatcctttctttagttgaagaaagggtatgtgtgtgcaagtgggtgtgtgtgtgccagtttttcttgtctcaggtagatactcccactgtgtataaatagatctacagacttttcatacttacctcccgtattctgtttctgtggtaaaaatatgaagtgttttagttgtatgttgagtgattggttggtattatcaacactgttgtttgcagtctcattaaagcatgctcttaaggagtacatatggtcattaattgccaactgtagattccagtgatctggcccctgcctacctccttcctctctttttcattctctgtcatgcttctccactgttttccccaatgatgcactattttgacacactggccttgctattccttaagcaaatcacattcttcccaatccaaagactttgcacatgctgttgtctttcttagaatgcccttcccctaggcctgcatggcttgctacctcacttaattgtttgacacttcctttggttcattgagcttcaaggctcttaaaatgccactgacaatgagatctccctttaaaaaaaaaaaaaa

SEQ ID NO: 202005 - DNA, 3714 bp, Homo sapiens; identical to SEQ ID NO: 202003
  Payload ID: 19849
  Gene Name: zinc finger protein 280B
  Uniprot ID: Q86YH2
  ENST ID: ENST00000613655
  CDS Start-End: 71-1702

SEQ ID NO: 202006 - DNA, 5721 bp, Homo sapiens
  Payload ID: 19849
  Gene Name: zinc finger protein 280B
  ENST ID: ENST00000626650
  CDS Start-End: 744-2375
atcccctgatggactggaagcctaccccccaccccaagccctggctgcgacagctctggaaccctgactgcctgggtgcccctcagctctggaaccctgactgcctggatgctcctcagctctggaaccctgactgcttggataccccctcagctctggaaccctgactgcctggaaccgtgatccggaacccaagatcctttcaaggcctcaggggtattgctgctgccctcctccttctcaatttaaccccgcgtccagccgtcgccaccaggggcgtcagagcgcgcgcatgctcctagctcggagccgcgccgatctcgcgccggcacctggcagccaatcgcaggtctccactggacgcgcgcgtgtggaggcgtgcgcgtcggcggcgccgggggcctgaggaggcgtagtcgccgccggctgtgccccgggagcgcctccggggctggtgcgtggccggcagctcgcgaacagcagctgatccggactggatgtgaccttctgcctggaatagctcaagttcttaaaagttgcgttgtaataaacctgaggctgggaagttcaagatcaagatgctggacgatttggttccttagtgaaggctctcttcctggctggtggatgacagccttcttgctgtgttctcacatgacagaaagaggaagcaaggtggcagtttatataaaggaagcattgggacttgtggccccaccattcaggaataaaaaaattagaaaatggaacaatcatgtgaggaagagaaagagcctgaaccacagaagaacatacaagaaaccaaacaagtagatgacgaagatgctgagctcatctttgttggtgtggaacatgtaaatgaagatgctgagctaatctttgttggggtgacttcaaattcaaaaccagtcgtttcaaacattttgaacagagtcaccccgggttcatggtcaaggagaaaaaagtatgatcaccttagaaaagatactgctcgcaaattgcagcctaaaagtcatgagaccgttacatcagaagcagtgaccgtcctgccagcttcccaacttgaatcgagatcaacagatagtcctattattattgagcctttgtctaaacctgattatagaaatagttcaccacaagttgtgcctaataactcttcagaattaccttctcctttgattacattcacagattcattgcatcatccagtaagtacagcactttcagtaggaggtataaatgaaagtcctcgtgtatcaaagcaactttccactttcgaagtaaacagcataaatcccaaaagggctaaactcagggatggaattatagaaggaaattcttcagcttcattcccttcagatacctttcatacaatgaatactcagcaaagtacaccctcaaataatgttcatacctcattaagccatgttcagaatggagcaccttttccagcagcttttccaaaggacaatatccatttcaagcctataaatacaaatcttgatagggcaaatgaattggcaaaaacagacattttgagtctaacaagtcaaaacaagacctttgatcccaagaaagaaaatcccattgtgttacttagtgacttttactatggacagcataaaggagaagggcagccggaacagaagactcacaccacctttaaatgcctcagctgcgtgaaagttctaaaaaatgttaagtttatgaatcacgtgaagcatcatttggaatttgagaagcagaggaacgacagctgggaaaaccacaccacctgccagcactgccaccggcagtttcccactcccttccagctacagtgtcacatcgaaaatgtccacactgcccaggagccctctactgtctgtaaaatctgtgaattgtcatttgaaacagatcaggtcctcttacaacacatgaaggaccatcataagcctggcgaaatgccctatgtgtgccaggtttgccattatagatcgtcggtctttgctgatgtagaaacacattttagaacgtgccatgaaaacacaaagaatttgctttgtcccttttgtctcaaaattttcaaaacagcaacaccatacatgtgtcattataggggccactggggaaagagtgcacaccagtgttccaagtgccggctacagtttttaactttcaaggagaaaatggagcacaagacccagtgtcatcaaatgtttaagaagcctaagcaactagaaggattacctcctgaaacaaaagttactattcaagtgtcgctggaacctcttcagccaggatcagtggatgtagcatccataactgtgagcacatctgactctgaaccatcactccccaggtctaaaagcaaaatttcaaaaaagtcccattaattctagtttcagtaaatctaaagcaagtatttcaaaccaaattaaaaaacctcataaaacaaaaaatacaaaccatacattattcagtagcaccaaaaatagtgaaactagtggattatatatgactttttaaacaagattcaggatatatattatttgatctgaattttgaggtattattttaaaacatctggttttcatgttaactgtatctggcttaacacataaaaggtgtttgtgtgtgtgtgtgagagagagaaaaaggtattaatttatttttttaattttaatttttttttttttttttttttttttttttactttagagacagggtctcactgttacccaggctggagtgcagtggcgtgatcctagctcactgcaaccttgaacttccaggctcaagcattcctccgcctcagcctttggagagtagctaggactacaggcgcagccaccacacccagctaattttttattttaattttttgtagcgatggaatcttgttatgtcgcccagggtggtctcgaactcctgaccttaggggagcctcctgcctcagcctccccaagtgctgggttgtgtgagtcactgcccctggcacctatttattgttttggtatttcatgttactcctaagcttgaaagctcttttttctatatacagaattcatagaatttttgaaatacttagttttctttacagctttttccatgcattcagcatttcatggttaactctagtcagactggaatggctttgttatgccctggcccacttgctgccgaattcccagaagtgcctctgctgtgctggcataaaataacctgaaaagattctgaaaagccaggatgtggaattgaaagagaagctgctgcgtgagcagagaccaagaaggcggaggttagttgagggagagcagtggttctttgttctagttgaagtataggcacacattcattctagtcttggggccaggtcaaaaggaacactgcttcagagtgtctttacctacctgaaaacatccaaggaagccaaaccattcaaagtaaaatgcttttgtttggtgaagggcccctgcagacatcaaacagccgtcatgtatcattggtttgaggtgaaatagcaataaaattaatagaatggtgcctggtactagctgacttcctgttctgtgatctaaaggtgaatttgattcattccctctcctctcccttctggctagccgttagtggagaatgaactggccatattctcagccacagctgtaaagcaagtttcccaaggggaagaagccctaatatctataatttgaactgtactggacccatagttttaactgaaaagggccaaacaagtggtgtctgtccagttcctggactgggctaaatttagttttcccactgttaagctggaatgaggactgtcccaacaacagtaggtacagtggacaaaaatagcccagggtgactgactgaatttaaacccataatggctttatatttttctgtgcatatatatcttaccctaattgaacatgtgaagcttgcaactttatgtcttgctttggacatgaatgtattacagcttgcagctattctgttaaatgtatagtttcccagttttttgacactaatgctgtttgggtcttacctgacacacaccagtgtgcaagaaatgtctctctaattcaataagttttaagacttagagttaatgtccttcatctgatctatcctatctaatctgtactatgggtgaatctttttcccttgctctccccaggggctgtttcacagtattctggagtaccttttgagtattggttcctgaacatcagcagtcttggctgcctctgtggactcccggagttgtctccctgcttgtgttctggtgccatcctttgttcctccacccctgaccaaggtgcccagcagcctgtcttcaccagtcaaggaatccgccatcttggctgtagacatacataggtctggagaaatctctccctttttccttgatttctttttaaaggtaccttatctctccccactcctttcttccctcctcaatctagttaaatttcctaagctttcacaaaaatccgggaagagataattaagagcttagcatccctcttagagtagaaggcagtacagataacaaagaagttgtgagtatattatctacattttagaaaattttctgactctagatccatagattctgttgtatttatttgccggacactcatttgattgatttgcaccttgaacactatactaggtcttttcagttacgttgcttgggttaagacactttgctaaaattacagcctgaatcctttctttagttgaagaaagggtatgtgtgtgcaagtgggtgtgtgtgtgccagtttttcttgtctcaggtagatactcccactgtgtataaatagatctacagacttttcatacttacctcccgtattctgtttctgtggtaaaaatatgaagtgttttagttgtatgttgagtgattggttggtattatcaacactgttgtttgcagtctcattaaagcatgctcttaaggagtacatatggtcattaattgccaactgtagattccagtgatctggcccctgcctacctccttcctctctttttcattctctgtcatgcttctccactgttttccccaatgatgcactattttgacacactggccttgctattccttaagcaaatcacattcttcccaatccaaagactttgcacatgctgttgtctttcttagaatgcccttcccctaggcctgcatggcttgctacctcacttaattgtttgacacttcctttggttcattgagcttcaaggctcttaaaatgccactgacaatgagatctccctttaaaaaaaaaaaaaaacttctacttttcctcttaaaggcactttactctctccccactcttttcttcctcttcaaagtatttaaatttcctaggttttcatgaaaaagctggaaagcgatcatcatcaagggctttgcttctgtcttagaattgagctagcttgagtcaatttctgtgcctgcaaccaaatgaaaattaatatagtgagttctttcaggagctttctctgtttttctattgatacctctatatatttttaaggcaatgtcactttgttttgtttacaaatatattgaatatgtcaagattactattttgttattgccctttgtgaatttccttgtctattttgctcgcttgttctttcaggtgaaatttattattttattaatgttgccaaaaattataagtaaaatatcaattatagtaataaaatgttttgtgaaaaaaa

SEQ ID NO: 202007 - DNA, 5721 bp, Homo sapiens; identical to SEQ ID NO: 202006
  Payload ID: 19849
  Gene Name: zinc finger protein 280B
  ENST ID: ENST00000627112
  CDS Start-End: 744-2375

SEQ ID NO: 202008 - DNA, 3981 bp, Homo sapiens; identical to SEQ ID NO: 202004
  Payload ID: 19849
  Gene Name: zinc finger protein 280B
  ENST ID: ENST00000630760
  CDS Start-End: 323-1954

SEQ ID NO: 202009 - DNA, 4634 bp, Homo sapiens
  Payload ID: 19850
  Gene Name: zinc finger protein 280C
  Uniprot ID: Q8ND82
  ENST ID: ENST00000370978
  CDS Start-End: 155-2368
ggttccgcgctggaagtctccgggggagtcgctgttgctgaggctgtcgcctgaggtttttcgcgctcctccctttcctcctcctctttctcctcctccttatccgaaccccagtcagaccgatctgctctgctctcggtgaccttgcaacttcatggatgacgacaaaccttttcaaccaaaaaacatttcaaaaatggcagaactctttatggaatgtgaagaagaagagctagagccatggcagaagaaagtagaagaaactcaggatgaggatgacgatgaactgatctttgttggagagatatcaagttcaaaaccagccatttcaaatattttgaacagaggccactccagctcatcttcaaaaggaataaagagtgagccacacagtccaggtattcctgaaatattcaggactgcaagtcaacgctgcagagacccaccatcaaatccagtggctgcctcgcctagatttcatcttgtatctaaatcttcacaaagctctgttactgttgagaatgcgtctaaacctgattttacaaagaattcacaagttggatcggataattcttcaattttactgtttgactcgacccaggaatcactaccaccatcccaagacataccagcaatttttagagaaggtatgaaaaatacttcatatgtgttgaaacatccttctacttctaaagtaaacagtgttactccaaaaaaaccaaagaccagtgaagatgttcctcagataaatccctccacttcattgcctttaattggctctcctccagtgacatcctcccaagttatgctgtcaaaaggtacaaatacctcatctccatatgatgctggagcagattacctaagagcttgtccaaagtgcaatgttcagttcaatcttttggatcctttgaaataccacatgaagcattgttgtccagacatgataactaaatttttgggagtaattgttaaatcagaacgtccatgtgatgaagacaagactgattcagagacaggaaagttgatcatgttagtcaatgagttttattatggaaggcatgaaggagtcactgagaaagagccaaagacttacacaacctttaaatgcttcagttgctcgaaagttcttaaaaataatattaggtttatgaaccacatgaaacatcacttggaacttgagaagcagaacaatgaaagctgggaaaaccacaccacctgccagcactgttaccggcaatatcccacacccttccaactgcagtgccacattgagagtacacacactccccatgagttttctactatttgcaaaatctgtgaattatcatttgaaacagagcatattcttttacaacatatgaaggacacccataaacctggtgaaatgccatatgtttgccaggtttgccagtttagatcatcaacattttctgatgtagaagctcattttagagcagcccatgaaaacactaagaacttgctatgtccattttgcctcaaagttagtaaaatggcaaccccctacatgaatcattacatgaagcatcagaaaaaaggagttcatcgttgcccaaaatgcagactacaatttttgaccagcaaggagaaagctgaacataaggcgcagcatcgtacatttataaagcctaaagaactagaaggattgcctcctggagcaaaagttactattcgagcttcacttggacctctccagtcaaaattaccaactgcacctttcggttgcgctccaggcacttcttttcttcaggtcacacctccgacatctcaaaatacaactgctagaaatcctagaaaatctaatgccagtagatctaagacaagtaagcttcatgcaactacatccactgcaagtaaagttaatacaagtaagccaaggggacgtatagctaagtccaaagcaaaaccctcttacaagcaaaagcgacagcgcaacagaaaaaataaaatgagccttgctttgaagaacataaggtgtcgtcggggaattcacaagtgcattgaatgtcattccaaaataaaagattttgcaagccacttttctatatacatccactgcagtttttgcaagtacaatactaactgtaacaaagcctttgtaaatcatatgatgagctctcatagcaaccatccaggtaaacggttttgtattttcaagaagcattcaggaactctcaggggcattactctagtgtgccttaaatgtgatttcctagctgattcttccggcttagatcgtatggctaaacacttaagtcaacgtaaaactcatacttgccaagttataatagagaatgtttccaaaagtacctcaacttctgaacccactactggctgctcattgaaatagattcctgctccatggagttcatgcaacctggtgcaagacaagttggaagttcctaagttcaaagttctgaagtattttctcacacaaagggcagttaaacagccaagtttatgacactagctctcattattcagctcttttcagctttcagatgccactacattgttattccaccttatctttgcgtcaggttaacatatcttaacatatttttttctccagttggctctctccaaaaatgccttttgtttttctctgctatacttgacttgccttcagaatattacattccagataatatgactgttcatctttttctgtctgttttgtctgctttcttaatttcttataagtcttacatgtttaggtcagataaccattttttcttcattccttgttcattactgttctatttttcatatttttcaaatgaagaagcaacacataagtttcaaaaaatatccagggtactcctggacagtgtccccttttgatggacacaactgatacctgttctttctttccaagaaatgtgaattatttgactgtgagacgtcctctagtttgtggccttcagaaatcagatcttggggagagtcccttcctacctgactgacctcccataaggctgatgctgatttggccagagatgacctcaaggcccaccaaatagagcacaacttcccattgggagctttggcttttgatcttaagcttatgggtcgattctaaccaagaaaagtccatgagatcagtgcttcaacatccaggttgacgtttaaccattttggctgctgctctttaattttcctctagcaggcatgcagtccaaggaatatcaaaattctgattgtatgggaaccaaggttactttcttgttcttggataaagaaaatttctacaattacagttcccaaagacacagttgttcatgttatttaaagttttatccagtattctaggaattttcagcaatactaatattctcatttttaaacattttttacattttattttgttttattttggtagcttggttttatattgtttttagatcagtgcttcaacatccaggctgacgtttagccattttggctgctgttctttaatcttcctctagcaggcatgcagtccaaggaatatcaaaattctggttgtattgggaaccaaggttactttcttgtttttggaaaaacaaaatttctacaattacagttcccaaagtcagttattcatgttttcatttaaagttttatccaatattctaggaattttcagcaatactgatattcactttattttttttctttttttaagacagagtcttgctctgtcacccaggctggagtgcagtggcgcgatcttggctcactgcaagctccgcctcctgggttcacgccattctcctgcctcagtctcccaagtacctgggatgacaggcgcctgccaccacgcccggctaatttttaattttttgtatttttagtagagacagggtttcaccatgttagccaggatggtctcgatctcctgacgtcgtgatcagtccgcctcgtcctcccaaagtgctgggattacaggtgtgagccactgcacccgaccgatactcacatttttaaactttttttttaattttattttggtagctaggttttatattgttcttaaatttattttactctattttatttttccatcacttctttgtcccagattcatgaaatttgctgatgtccattttatgtctacttttgaactcttctctttgtgtttgttttgttcttattacaaactccaagacatttcttagaattgtctacagatttcgtgtagctacttattggtagcttcttaatttcatacttgtccagaccattagacattattacatgctctgtcttgggcctatcattaacattagcttagggattctgatttcaaagacataaagaattggcaaaactcttcttacagaacttaaaacaagttttaaagttacatttctatacatctaatacataataccttcttagccattaatgtaattcctctggataaagataatatattcaaaaaatattgggaccaaaaaatgcacttgtttcttgctcatatatatatagatgtatattttttttaatttcttgtttgtttattttggttacattgaatacagatttgctgaacagttttgatgttatttttttaataaaatttgtattgttaaagtgccttggaaatttctaataaataacttcatataaaa

SEQ ID NO: 202010 - DNA, 1970 bp, Homo sapiens
  Payload ID: 19850
  Gene Name: zinc finger protein 280C
  ENST ID: ENST00000447817
  CDS Start-End: 139-1970
tctccgggggagtcgctgttgctgaggctgtcgcctgaggtttttcgcgctcctccctttcctcctcctctttctcctcctccttatccgaaccccagtcagaccgatctgctctgctctcggtgaccttgcaacttcatggatgacgacaaaccttttcaaccaaaaaacatttcaaaaatggcagaactctttatggaatgtgaagaagaagagctagagccatggcagaagaaagtagaagaaactcaggatgaggatgacgatgaactgatctttgttggagagatatcaagttcaaaaccagccatttcaaatattttgaacagaggccactccagctcatcttcaaaaggaataaagagtgagccacacagtccaggtattcctgaaatattcaggactgcaagtcaacgctgcagagacccaccatcaaatccagtggctgcctcgcctagatttcatcttgtatctaaatcttcacaaagctctgttactgttgagaatgcgtctaaacctgattttacaaagaattcacaagttggatcggataattcttcaattttactgtttgactcgacccaggaatcactaccaccatcccaagacataccagcaatttttagagaaggtatgaaaaatacttcatatgtgttgaaacatccttctacttctaaagtaaacagtgttactccaaaaaaaccaaagaccagtgaagatgttcctcagataaatccctccacttcattgcctttaattggctctcctccagtgacatcctcccaagttatgctgtcaaaaggtacaaatacctcatctccatatgatgctggagcagattacctaagagcttgtccaaagtgcaatgttcagttcaatcttttggatcctttgaaataccacatgaagcattgttgtccagacatgataactaaatttttgggagtaattgttaaatcagaacgtccatgtgatgaagacaagactgattcagagacaggaaagttgatcatgttagtcaatgagttttattatggaaggcatgaaggagtcactgagaaagagccaaagacttacacaacctttaaatgcttcagttgctcgaaagttcttaaaaataatattaggtttatgaaccacatgaaacatcacttggaacttgagaagcagaacaatgaaagctgggaaaaccacaccacctgccagcactgttaccggcaatatcccacacccttccaactgcagtgccacattgagagtacacacactccccatgagttttctactatttgcaaaatctgtgaattatcatttgaaacagagcatattcttttacaacatatgaaggacacccataaacctggtgaaatgccatatgtttgccagaaaaaaggagttcatcgttgcccaaaatgcagactacaatttttgaccagcaaggagaaagctgaacataaggcgcagcatcgtacatttataaagcctaaagaactagaaggattgcctcctggagcaaaagttactattcgagcttcacttggacctctccagtcaaaattaccaactgcacctttcggttgcgctccaggcacttcttttcttcaggtcacacctccgacatctcaaaatacaactgctagaaatcctagaaaatctaatgccagtagatctaagacaagtaagcttcatgcaactacatccactgcaagtaaagttaatacaagtaagccaaggggacgtatagctaagtccaaagcaaaaccctcttacaagcaaaagcgacagcgcaacagaaaaaataaaatgagccttgctttgaagaacataaggtgtcgtcggggaattcacaagtgcattgaatgtcattccaaaataaaagattttgcaagccacttttctatatacatccactgcagtttttgcaagtacaatactaactgtaacaaagcctttgtaaatcatatgatgag

SEQ ID NO: 202011 - DNA, 4328 bp, Homo sapiens
  Payload ID: 19851
  Gene Name: zinc finger protein 280D
  Uniprot ID: Q6N043
  ENST ID: ENST00000267807
  CDS Start-End: 218-3157
acggctcggctgccagctccgcaatgggagccgccgccgtcgccgcagtgtagtttttcgtgctcctccttttcctcctcctctttctcctcctcctcagggctccagtcaggccgatccgctccgctcacggaaggaaaacagaaataacttgctggcttgtctggagtcacatgtacttaggtgacaatttacagaaagtcatctctgcagcttgatgggcgacaacccttttcaaccaaaaagtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctggttatataacaaactcatcacgagttgtgtctaataagtcatcagagttactgtttgacttgacccaggatacaggattatcacattaccaagggggaccaacactttctatggcaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtacaaatacctcatcaaatcagtctaaaaatggaacaccttttccaagagcttgtccaaagtgcaacattcatttcaatcttttggatcctttgaaaaatcacatgaagtattgttgtccagacatgataaataactttttgggactggctaaaacagaattttcaagtacagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacagtcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgagctttcatagtaaccgtccaagcaaaaggttttgtatttttaagaagcattcagaaaatctccggggcattactctagtgtgccttaattgtgatttcctaagtgatgtttctggcttagataatatggctacacacttaagtcaacataaaactcatacttgccaagttgtaatgcagaaagtttctgtttgtatcccaacttctgagcacctttctgaattaaaaaaagaagctcccgcaaaggaacaagaacctgtgtctaaggaaattgcaagacctaacatggctgaaagagaaacagaaacatcaaattctgaaagtaaacaagataaagctgcttcttcaaaagaaaaaaatggatgtaatgcaaattcatttgaaggctcatcaacaacaaaaagtgaagaaagcataacagtttcagataaggaaaatgaaacctgtcttgcagaccaggaaactggctcaaaaaacatcgtcagttgtgattcaaatattggtgcagataaagtggaaaagaaaaaacaaatacaacacgtttgtcaggaaatggagttgaagatgtgccaaagttcagaaaacataatcttatctgatcagattaaagatcacaactccagtgaagccagattttcttcaaagaatattaaggatttgcgattagcatcagataatgtaagcattgatcagtttttgagaaaaagacatgaacctgaatctgttagttctgatgttagcgagcaaggcagtattcatttggaacctctgactccatccgaggtacttgagtatgaagccacagagattcttcagaaaggtagtggtgatccttcagccaagactgatgaagtagtgtctgatcaaacagatgacattcctggaggaaataaccctagcacaacagaggcaacagtagacctggaagacgaaaaagaaagaagttgaaattagtcattttaagtttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtagggattcccaaaaagtttttaaaaacacgaacaggattttaatgataattaaatttgcagtggaaaggtctcatttaatggttttcaaggaaatgggatttggttgctgacatgaattgatgatattagtaatatttataaagcctttcaaacttccatcaatcctaagctaaaaatctttattacctgtatatccttttcagttaactgagaggaagggatttggaaaccatgtacttttggggagtaattgattaaaaacaatggctgattggcattgttaatgaaggctttatttgtgaggatgatgctggtaaatggagcatgcttagagtactaaattgatctaatgagaatttggatgaacataaacttaattttggatttaatataacattccagtcagacgcatgtaaacagaatatttgaatctttgtacctccatacaagtgttagcctgccaggctgtaagcttaccttaattaaactttcagtgaaagtggaattattaagatataaatttatatttgtgctttttgtcagtgtgtaagctgtgtagaaattctttgatgtattagttgtattaatgtaaagtagaaacccattgttgaaactcctgtagctattatgcttttaatattgttttaatgatcttccttagaaataggcccataaaaatggtctggaagccaaaccaaagtatggtataatgtagatattgtaaagcagtaaactgaaaacatgtcctggcatgtattcagccatgtttaagtgacttttctgtaattgtaaaataaaaacttcaaatgggacctaaaacagtgatgtaaaagaactggttttggaaatttagcctaatttatctataagatggctgctaaattgatttttcagttctttttatcatctagaatataatagatatagaaatgaataatatgaagaacagtagtttgctttgaaatactaataaacttttattt

SEQ ID NO: 202012 - DNA, 4726 bp, Homo sapiens
  Payload ID: 19851
  Gene Name: zinc finger protein 280D
  ENST ID: ENST00000559000
  CDS Start-End: 1801-4044
gaagtggggccggcagagggggcggggaggagctgtcggggactgggaggagccgcaccgcggcgggtggacaaagcccgcggtcgggtgaggcgggacggagttggggccggtggggaggggcatgaggcgctcgcaggcacctcgagaagcaggccccgaccgctcgccgacgaagcctcgtccgggcctcctgggagcggggtggcaggtaccgtggcgcctcctcgcgttggtcttgctggttctcggcccccgaagcggagcgacggagacacagctgtggaagcatctggatccgctgcccaggtccccgagcttcccggaacccgaggccgcaggacactgaaggctgccattcccgagtaggtcacgctggacgccaccctaagctgggcccagaggctcccgtccaggagggctgcagtcggcgcagacaccgcgcgtgtggagacgggagacccatcctcctcggccgttccgagagtaggcgcggccggtcagattcgatgcagagccgaatgcgggagaaagggcaaaacgtacctcaaaccagacaaagccttgtgagcttcaggttctcaaataccccactcacccagaccccacatctccagtcagcccctcgcacccaaatcccattcggagcaaccgaactgcacgtgggactagttcttgggaatggatcaagccagtctcttcatctaacggagacagccctgggtggctctgtcacacagccactgtcttgtgcacaagttctgaacttggcctcagagaagccccagagtagaaagaagacaaaataagccccagttcttcgattctgggctgaagtgagattttcttgaatggcagccattgttttgcctcttaggtaagtgagtgcagtaaagaccggtaaggcccacgcagaagaaacactgaggaaagaagacacttccaaagtaacaaatgggaggaagcagccaacgcccgaggacaacatggcaagaaggagcctttggattccggactgggatggaaagagagttgattgaatcccggaatttggaaaccccagatacggagggcggacggtacaaccggagctgtcagaatcttgctctgtcacccaggctggagtgcaatggtgcaatctcaagctcactgcaacctctgtgcaggttcaagtggagaatctgaatcttgatgatataattggaactcttcagccaagccatatctaacagaactatcttcaacttttcaggtgttggtgaggatgcagagaaaagggaaactcatacactgctgatgggaatgcaaaccagtacaacttctatggaaaacgatatggagactctcaaagaactaaaagcagaaccatcattccgtccagcaatcccaccactggtcatctacccaaagtttgggtatcaaaaatatacttacaaaagaagtaaagagagctcacctatttttgtcttcactgaatgaaaaagtctgttcaatacaggaaataaactttgaagatttggtaaaactcacctctttgggtgatttggagtacagatagtatagtccttgagttgtcaattggaagtcactgataccacacggtttaagattatctgactctcagctatacaggattgctgactgctgctagaaaggccttcataaccaaaatgcaacatggaaatagctttcttacattccatgagaaaaaaaatagatctgacaacgttattgaatagaaaaaggaaggaaaacagaaataacttgctggcttgtctggagtcacatggtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctggttatataacaaactcatcacgagttgtgtctaataagtcatcagagttactgtttgacttgacccaggatacaggattatcacattaccaagggggaccaacactttctatggcaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtacaaatacctcatcaaatcagtctaaaaatggaacaccttttccaagagcttgtccaaagtgcaacattcatttcaatcttttggatcctttgaaaaatcacatgaagtattgttgtccagacatgataaataactttttgggactggctaaaacagaattttcaagtacagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacagtcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgagctttcatagtaaccgtccaagcaaaaggttttgtatttttaagaagcattcagaaaatctccggggcattactctagtgtgccttaattgtgatttcctaagtgatgtttctggcttagataatatggctacacacttaagtcaacataaaactcatacttgccaagttgtaatgcagaaagatgcagaagcagcccagagatttcaaaaaatatccagggtatacctggacagtgtcccccttcgatggacacaactgatgcctgttctctctttccaaggaatgtgaataatttgactgtgggacctgctcttaggttgtggcctcaagaaatcagatcttggggagactccctttctacatggctggcctcccataaggctgatgttgtttggccagagatggctttaaggcccaccaaattgagcatacttcccactgggggctttggcttatgatcttaagcttatgagtcagttatgaccaagaaaagcccatcaaaccactgcttcagcatccaagttgaagtttagtcattttggctgctgcctttaaatctttctctagcatgaatgcagtccaaggaatataaaaactctagttgttaggaaaccatggctactttcatatccttggaacaacaggtctccacaattaagttccaaaattgcagttatttttactgacatataaaatctattaaccagtattaattctgtaattttttaacaataccgattcttgcattttgattttttaaaaattaatttaatagcttggttttatgttctcaaaatttattaatgtctattttatgatgtctatttttatattatattatttaaaatttgtttagtgtttgttttaagaactccaagagatttcttagaattctctacagattttgtgtagctgcctatttgtagattttaaatttggctgttactaagcccattaaacattattagat

SEQ ID NO: 202013 - DNA, 2274 bp, Homo sapiens
  Payload ID: 19851
  Gene Name: zinc finger protein 280D
  ENST ID: ENST00000558002
  CDS Start-End: 136-1743
ctttctcctcctcctcagggctccagtcaggccgatccgctccgctcacggaaggaaaacagaaataacttgctggcttgtctggagtcacatgtacttaggtgacaatttacagaaagtcatctctgcagcttgatgggcgacaacccttttcaaccaaaaagtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctggttatataacaaactcatcacgagttgtgtctaataagtcatcagagttactgtttgacttgacccaggatacaggattatcacattaccaagggggaccaacactttctatggcaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtacaaatacctcatcaaatcagtctaaaaatggaacaccttttccaagagcttgtccaaagtgcaacattcatttcaatcttttggatcctttgaaaaatcacatgaagtattgttgtccagacatgataaataactttttgggactggctaaaacagaattttcaagtacagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaatcagctcttgaatatttgctccagtggagggaaacagaggcatggataatccaaagtgaataatccccaaaacatttatttttggctttgggtactttcctttgaatgtgggtatgtctgttatttgaattaactaaaacaatataaagccatgctctgaagacatgatagcaagagaagctatccagcatccttccctgcaatccattcattccatgttgggactagacatgcagaacactaatgttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacagtcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtatcgtcggggcattcacaaatgcattgagtgttgttccg

SEQ ID NO: 202014 - DNA, 4040 bp, Homo sapiens
  Payload ID: 19851
  Gene Name: zinc finger protein 280D
  Uniprot ID: Q6N043
  ENST ID: ENST00000560002
  CDS Start-End: 91-1869
tttattttataggaaggaaaacagaaataacttgctggcttgtctggagtcacatggtgacaatttacagaaagtcatctctgcagcttgatgggcgacaacccttttcaaccaaaaagtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctggttatataacaaactcatcacgagttgtgtctaataagtcatcagagttactgtttgacttgacccaggatacaggattatcacattaccaagggggaccaacactttctatggcaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtacaaatacctcatcaaatcagtctaaaaatggaacaccttttccaagagcttgtccaaagtgcaacattcatttcaatcttttggatcctttgaaaaatcacatgaagtattgttgtccagacatgataaataactttttgggactggctaaaacagaattttcaagtacagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacagtcaaatccaacgcaagtaaacctaatacaagtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgagctttcatagtaaccgtccaagcaaaaggttttgtatttttaagaagcattcagaaaatctccggggcattactctagtgtgccttaattgtgatttcctaagtgatgtttctggcttagataatatggctacacacttaagtcaacataaaactcatacttgccaagttgtaatgcagaaaggtacgtatatgtaactgtgctactttagatttttgacttttattccagtatttttggtcatccacaatatggtctctttactaaatcattattctcactcatcatatttcatatgctgttgtaaatgtaaaacttttcttctaatttcagtttctgtttgtatcccaacttctgagcacctttctgagtaagtttaatttttattcagtgcattttactttgatggattttagcactattgcatttttaaatgtatcattaatacgaatgaaaagtattaaagtatgttgttgtttttttgttttttttttaaagctgcttgttgaaataggttcctgctctatggagctcgtgacctggtgcaagacaagttggaatttcctaagttcaaagttctgagatgttttcttacacaaaggcagttgagcagccaagttcatgacactagctctcattattcagctcttttcagctttcaaatgggactagattcttattccaccttatctttgtgtcaggttgacatatcttaacatatttttttttctccagtttgcgctgtctaaaaataacatttgttgctatggtcttttctttgcttacaataatttttgtttttctctgctgtacttgccttcagaataatagattccaaattatatggctgtttgtcttttgtctgtttgtctgctttcttaatttcttatacgtcttaagttttaggccagataattgtctttttctcattcgttgtctgtcattgtgctatttttcttatttttcagatgcagaagcagcccagagatttcaaaaaatatccagggtatacctggacagtgtcccccttcgatggacacaactgatgcctgttctctctttccaaggaatgtgaataatttgactgtgggacctgctcttaggttgtggcctcaagaaatcagatcttggggagactccctttctacatggctggcctcccataaggctgatgttgtttggccagagatggctttaaggcccaccaaattgagcatacttcccactgggggctttggcttatgatcttaagcttatgagtcagttatgaccaagaaaagcccatcaaaccactgcttcagcatccaagttgaagtttagtcattttggctgctgcctttaaatctttctctagcatgaatgcagtccaaggaatataaaaactctagttgttaggaaaccatggctactttcatatccttggaacaacaggtctccacaattaagttccaaaattgcagttatttttactgacatataaaatctattaaccagtattaattctgtaattttttaacaataccgattcttgcattttgattttttaaaaattaatttaatagcttggttttatgttctcaaaatttattaatgtctattttatgatgtctatttttatattatattatttaaaatttgtttagtgtttgttttaagaactccaagagatttcttagaattctctacagattttgtgtagctgcctatttgtagattttaaatttggctgttactaagcccattaaacattattagatactctgtcctattgggattattattaatattaccttaattgtgagttcttaggtgtaaagaattggcaatactacttgcagaccttaagagccagttttaaagttacgtatttgtgcgtctaagatgtaatgtctacttagccattaatgtagctcctttgggtaaaggtaacatgttaaaaaacatacatatggtgaccagtaatgcatgtatttctttcctttatatattttaaatttgtcatgtgtttattttagttacattgaatatagatctaaactttttatactattatccttttaataaaaattatattgttt

SEQ ID NO: 202015 - DNA, 3666 bp, Homo sapiens
  Payload ID: 19851
  Gene Name: zinc finger protein 280D
  Uniprot ID: Q6N043
  ENST ID: ENST00000558320
  CDS Start-End: 116-592
ctcagggctccagtcaggccgatccgctccgctcacggaaggaaaacagaaataacttgctggcttgtctggagtcacatggtgacaatttacagaaagtcatctctgcagcttgatgggcgacaacccttttcaaccaaaaagtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctgtaagtgtttctaaaactatacggccagctcagggatccattggatgttgtttatcaatatcaacagtacccagttacaattctggactgtcataagtagtcatccagtagaagcatagttagcatcagaaaatgtcaccatattttcgctagctcaagcagtaccccaagtaataactgaaggagctaactacccaacctgttaataacaggcagtatgcctaaataggtacagtaatgaaaactatactatcaaaatgtgaataaaattatagtcagccataaatattgcataatgacaaatatttaagattgcagacgggaccaggtattcttaattgggaaaacagtcaagtgaccatcatagctttttattctgaaaacattccttcatagttcagttagttaaaaaaaaacaaacattttttcctattacaaaaaactcccactttttttgttacaaaaagtaatagaaaatggtaatagttaacattcattgagctgttaatatgtataagtgtttgtgctaaatgctataggtaaattcatttcatttagttcttaaacatccccatgaagtaaacactattattatcctcattttttagttgaggaaactgaggctcatagaggttgaaagatttattcaagatcccaaagctggcagttgatggatctgggatttcaatccagcctaacccatagtttatatgtatatgcacacatacatacatatatgttgtgtataaatgtacacttttttagacatgaaagaattgccttagttgaacagttctcagattgtagtttgcaatcccctggggttccccaagaccctttcagaggtttgagggtcaacagtgttgtcattataatcaaagactgttttccttttccactgtgttggcatttgcactggtgatgctaaagtaatggtggataagctgctggtgccttagtgtgaatcaaggtagtgccaccaaagtgtacttgtagtttctgtattagtcacctgccgtgcactcacagtaaactacattactcaactgagtattacccagttatacccaatccctgatgaagtattaaaatgttattagttttattaactctctacacttgaatgtgtgttttttaaaatattctgtgtgatgacatgggtagtgtgcataaagtacctctgtgtctgaagtatgatagttgtcttgaggaaaagcacttgtgtgattgaattgtgaggtaaactacctgatttttttttgttgttacatgaaagaatgagtgacaaatctttaaagtatttacaatatcactccagaaaagaaaacaaatcaaataaatattgactcaaaactctccaagtacatatcaaaatctcaggaagggaaaaaagagtctaaagaacaaaatataacactattttatttcagtcatgttagttcagtttccacagtttgaactgggtatagattaatatctaaaaccaaaaaatgaacatgtgtatagtgatgctgaaaaatgtgcattattttttatttatattttaggaataataaagttagttattaaagaatttagtgattttgattgagtgagaggtgtgagctatatttgcttctttcctgtatgatatacatacattgtttccaatctcatttctattaaataactataggagagcccacagccttgttattttacatatcactatttagatatttgttatttatttatttgtgttggcctgaagtaaatgttacttttgtacgatatttgaaggatagatttattttataaattaatagtttaaataagattttgccagcatttgaaatgatatttatttctgtgtatcaatattaccacaaacttacacagcttaaaacaacatacactctttatctcatgatctcacaatttctgtgggtcaggaatcaggtcatggcttaggtgggttttctgcttaaggatctcacaaggctgcattcaagatgtggtgcctgaagttgcagtttcatctgaaattctgttggggaagtatttgcttccaagttcacatggttgttggtagcattcagttccttaagggatgttggactgagaatctctgtatcttgttggcttttggctggctccttgccacgtaggtcttcccaataaggctgcttgcttcctcaaagctagcaggtgagagtgagtccttagcaagatgcccttacagtcttaggtaacataatcacgtacacaaaaatcatatatatcctgtcacctttgttgtgttctattggttaaaagcaagtcagaggtcctgcccacactcaatgggagggaattacacaggacctgaataccaggacctggggattatgggtaatgacatttacatggaggccactttagagtctgtctgccacacacgcttagtcaatcttgattgtttggcaaacatttcctcaaatctgtcacttcagcaaaaataattgatagtaatatttcttaccaatggtaaaatttgaacttttaagcaaaaattagaattttggaaaactcatttgccaccgtgatcttggcagcttttgaataagagttttctgatgggtggtggtgttcataaataatgatttttaaaatattgtgtaatgaactatgtcaccatttggaagacctgtgtaattcagtgaaactagtattttccacataactagtatatatactacaaaagtatgcatgggtaaaacatacatttaaaagctaagatagaccaatgattttaatggaacgggtgttctgggatacggtttcagatttcacactgcaacaaacctttaagaaagtaccaactgttcagttttggtatagtatcaaagtagtatatccacagttaattaaaaccctattaaaacactcccttttccagttatatattcctgtgaggcagaatttaataatactcctcaaccaaaacaacatgtcatagtagactgaaggcagaagcagataagagactaaaacaatttttgattaagctagatatttaagagctttgcaaagatgtgaaacaatgccacttttcactagttttttttgcgtttgcaagtcatttttcattaaaatgttatttatgttaatttgtaatgagtttgttattttaaaatgaataaataaatatt

SEQ ID NO: 202016 - DNA, 428 bp, Homo sapiens
  Payload ID: 19851
  Gene Name: zinc finger protein 280D
  ENST ID: ENST00000559352
  CDS Start-End: 188-428
gtgctcctccttttcctcctcctctttctcctcctcctcagggctccagtcaggccgatccgctccgctcacgatctgtgcagaaatcattgtggttagagggaaggaaaacagaaataacttgctggcttgtctggagtcacatgtacttaggtgacaatttacagaaagtcatctctgcagcttgatgggcgacaacccttttcaaccaaaaagtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgag

SEQ ID NO: 202017 - DNA, 4902 bp, Homo sapiens
  Payload ID: 19851
  Gene Name: zinc finger protein 280D
  Uniprot ID: Q6N043
  ENST ID: ENST00000559237
  CDS Start-End: 685-3585
gacctcgacagggaacgcaagcaaaaccacacatttaaaacagacttggtaaaatcagctcgttatttaaagaaacggacgattcctttttctctcctggtttagtcttcgacccacaggccccttgcttctttcgaacggcggctgtatcccatgaccttttcactttccaagccaacggactgggggtcgttacacacgcggagggcccggaacgcacggctcctcgcctgcaaattccgagcagtccggattttggggctgcctcccggccacaccagccagcagctcgcacccacatggaggcagggccctggccctcgccccggaccggcgcgtggcggggcgcgtgggtcttcgagggcccgcgacgcggcgcacatgccggtgcccgcctcccgcgtcggcgagaagacagggagctcggacacggggaggctgacccggagcctacccatgaggcagcgcgccggctgcacgagagcccccccctttccacggctcggctgccagctccgcaatgggagccgccgccgtcgccgcagtgtagtttttcgtgctcctccttttcctcctcctctttctcctcctcctcagggctccagtcaggccgatccgctccgctcacggaaggaaaacagaaataacttgctggcttgtctggagtcacatggtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctggttatataacaaactcatcacgagttgtgtctaataagtcatcagagttactgtttgacttgacccaggatacaggattatcacattaccaagggggaccaacactttctatggcaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtacaaatacctcatcaaatcagtctaaaaatggaacaccttttccaagagcttgtccaaagtgcaacattcatttcaatcttttggatcctttgaaaaatcacatgaagtattgttgtccagacatgataaataactttttgggactggctaaaacagaattttcaagtacagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacagtcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgagctttcatagtaaccgtccaagcaaaaggttttgtatttttaagaagcattcagaaaatctccggggcattactctagtgtgccttaattgtgatttcctaagtgatgtttctggcttagataatatggctacacacttaagtcaacataaaactcatacttgccaagttgtaatgcagaaagtttctgtttgtatcccaacttctgagcacctttctgaattaaaaaaagaagctcccgcaaaggaacaagaacctgtgtctaaggaaattgcaagacctaacatggctgaaagagaaacagaaacatcaaattctgaaagtaaacaagataaagctgcttcttcaaaagaaaaaaatggatgtaatgcaaattcatttgaaggctcatcaacaacaaaaagtgaagaaagcataacagtttcagataaggaaaatgaaacctgtcttgcagaccaggaaactggctcaaaaaacatcgtcagttgtgattcaaatattggtgcagataaagtggaaaagaaaaaacaaatacaacacgtttgtcaggaaatggagttgaagatgtgccaaagttcagaaaacataatcttatctgatcagattaaagatcacaactccagtgaagccagattttcttcaaagaatattaaggatttgcgattagcatcagataatgtaagcattgatcagtttttgagaaaaagacatgaacctgaatctgttagttctgatgttagcgagcaaggcagtattcatttggaacctctgactccatccgaggtacttgagtatgaagccacagagattcttcagaaaggtagtggtgatccttcagccaagactgatgaagtagtgtctgatcaaacagatgacattcctggaggaaataaccctagcacaacagaggcaacagtagacctggaagacgaaaaagaaagaagttgaaattagtcattttaagtttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtagggattcccaaaaagtttttaaaaacacgaacaggattttaatgataattaaatttgcagtggaaaggtctcatttaatggttttcaaggaaatgggatttggttgctgacatgaattgatgatattagtaatatttataaagcctttcaaacttccatcaatcctaagctaaaaatctttattacctgtatatccttttcagttaactgagaggaagggatttggaaaccatgtacttttggggagtaattgattaaaaacaatggctgattggcattgttaatgaaggctttatttgtgaggatgatgctggtaaatggagcatgcttagagtactaaattgatctaatgagaatttggatgaacataaacttaattttggatttaatataacattccagtcagacgcatgtaaacagaatatttgaatctttgtacctccatacaagtgttagcctgccaggctgtaagcttaccttaattaaactttcagtgaaagtggaattattaagatataaatttatatttgtgctttttgtcagtgtgtaagctgtgtagaaattctttgatgtattagttgtattaatgtaaagtagaaacccattgttgaaactcctgtagctattatgcttttaatattgttttaatgatcttccttagaaataggcccataaaaatggtctggaagccaaaccaaagtatggtataatgtagatattgtaaagcagtaaactgaaaacatgtcctggcatgtattcagccatgtttaagtgacttttctgtaattgtaaaataaaaacttcaaatgggacctaaaacagtgatgtaaaagaactggttttggaaatttagcctaatttatctataagatggctgctaaattgatttttcagttctttttatcatctagaatataatagatatagaaatgaataatatgaagaacagtagtttgctttgaaatactaataaacttttatttaaaatgcttcatttttacttcttaaaatgtgctttggattcttaaattttgtttcactgaatgttcaatgttttaaatggcgattaaaatactctgctgtatatagtagtttttgagtaaatatttgcaataaaaatctgcccccg

SEQ ID NO: 202018 - DNA, 3528 bp, Homo sapiens
  Payload ID: 19851
  Gene Name: zinc finger protein 280D
  Uniprot ID: Q6N043
  ENST ID: ENST00000558067
  CDS Start-End: 48-1313
cagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacagtcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgagctttcatagtaaccgtccaagcaaaaggttttgtatttttaagaagcattcagaaaatctccgatgcgtgggaggacaaatagaatgtgacttgcctaagttacacaagttggttgtggagccaagactgactctaggtcttctgactcctaacttttaacaattggtatgacaggggcattactctagtgtgccttaattgtgatttcctaagtgatgtttctggcttagataatatggctacacacttaagtcaacataaaactcatacttgccaagttgtaatgcagaaagtttctgtttgtatcccaacttctgagcacctttctgaattaaaaaaagaagctcccgcaaaggaacaagaacctgtgtctaaggaaattgcaagacctaacatggctgaaagagaaacagaaacatcaaattctgaaagtaaacaagataaagctgcttcttcaaaagaaaaaaatggatgtaatgcaaattcatttgaaggctcatcaacaacaaaaagtgaagaaagcataacagtttcagataaggaaaatgaaacctgtcttgcagaccaggaaactggctcaaaaaacatcgtcagttgtgattcaaatattggtgcagataaagtggaaaagaaaaaacaaatacaacacgtttgtcaggaaatggagttgaagatgtgccaaagttcagaaaacataatcttatctgatcagattaaagatcacaactccagtgaagccagattttcttcaaagaatattaaggatttgcgattagcatcagataatgtaagcattgatcagtttttgagaaaaagacatgaacctgaatctgttagttctgatgttagcgagcaaggcagtattcatttggaacctctgactccatccgaggtacttgagtatgaagccacagagattcttcagaaaggtagtggtgatccttcagccaagactgatgaagtagtgtctgatcaaacagatgacattcctggaggaaataaccctagcacaacagaggcaacagtagacctggaagacgaaaaagaaagaagttgaaattagtcattttaagtttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtagggattcccaaaaagtttttaaaaacacgaacaggattttaatgataattaaatttgcagtggaaaggtctcatttaatggttttcaaggaaatgggatttggttgctgacatgaattgatgatattagtaatatttataaagcctttcaaacttccatcaatcctaagctaaaaatctttattacctgtatatccttttcagttaactgagaggaagggatttggaaaccatgtacttttggggagtaattgattaaaaacaatggctgattggcattgttaatgaaggctttatttgtgaggatgatgctggtaaatggagcatgcttagagtactaaattgatctaatgagaatttggatgaacataaacttaattttggatttaatataacattccagtcagacgcatgtaaacagaatatttgaatctttgtacctccatacaagtgttagcctgccaggctgtaagcttaccttaattaaactttcagtgaaagtggaattattaagatataaatttatatttgtgctttttgtcagtgtgtaagctgtgtagaaattctttgatgtattagttgtattaatgtaaagtagaaacccattgttgaaactcctgtagctattatgcttttaatattgttttaatgatcttccttagaaataggcccataaaaatggtctggaagccaaaccaaagtatggtataatgtagatattgtaaagcagtaaactgaaaacatgtcctggcatgtattcagccatgtttaagtgacttttctgtaattgtaaaataaaaacttcaaatgggacctaaaacagtgatgtaaaagaactggttttggaaatttagcctaatttatctataagatggctgctaaattgatttttcagttctttttatcatctagaatataatagatatagaaatgaataatatgaagaacagtagtttgctttgaaatactaataaacttttatttaaaatgcttcatttttacttcttaaaatgtgctttggattcttaaattttgtttcactgaatgttcaatgttttaaatggcgattaaaatactctgctgtatatagtagtttttgagtaaatatttgcaataaaaatctgcccccg

SEQ ID NO: 202019 - DNA, 4891 bp, Homo sapiens
  Payload ID: 19852
  Gene Name: zinc finger protein 281
  Uniprot ID: Q9Y2X9
  ENST ID: ENST00000294740
  CDS Start-End: 126-2813
acactgcgccgcggctgcgcagtacacgggaggcttttaattccattgtggagaggacggcgttatttttattaactggaggcgacggcggctgcggcggcggcgggacccgcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccagggtatggttatgttcaaccaccgtcttcccccggtcaccagcttcacccggccggcggggtcggccgcccctcccccgcaatgcgtgttatcctcctctacctccgcagccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgcaaaaaaaaagacaaaaaaaaaccaaaaaaaaaaaacctacaaaaaaaactttgttgctaggattaaggttattctaattgctttactctcaggaaagtgtaataacgcatgggaattctgtacgttatcactgtaatggaatatccaatttacagatagtatgatatacatttcatcatttaagtaagggatcgaaaacatttcaaattgctctatctgggctgatagacatttcgtcatttaagtaagggatcgaagacatttcaaattgctatctccatctgggctgatccaaaattctgagattgttggctacctatattttgttgcagcttttaaatgtactctgaacttccaaaccacattcattccagcctggtagaacaaatattcttggatctttgatcaaagcctggaatgatagctttaataaaagaaggaaaaaaaaaaagcaccctctcttgatctcaactgtaacaaggctgtaattccatcaagcgattctactgacatctagtacagtgttgaagcccaagtggttggctggttccagtattagaactcaagttgaaattatatgattaactgaaatttggggcatgcattatttattatacatggcctacaacggttctgtctgcgctgttacgtattacctacacttctgggtttttttgttcttgttctcagcctctctttaagagttcttgggccttccttttccctctttctattttaacagttttaattttagaaccatttacattccagtaggtaattcactatgcgctttatatgccttagggcatccaaataaaaaacaatagggtaaacatccccaaaacccacctttaaaaaaaaaaaaacccatacagatttccatatgtaataaaaccccgtgttcttggatagatattaataaggttgtaattccaactggtgacataactcctgtgagggataagaatgtgtctgcttatagtaataacatcagaacctctttgtgaaattgcggcctttaatgtacattttaatgaaagggtgcattagtattgtacaggggtcttgtaaagtcatcaaaacttgctatgaactctaattgccatttgaagctactgattggcagtggctctactctaaaactgctttttagcaattgtatttttttcctgattatattttttaatgtactttgatgtttatgctgatgagttttttatgtacttttggtgatgtttcagtcttatgtactcttctgacgtcagaaaagtaccactggttgtttgcagtcttattgtgtaatcagcctaccgcaggcttccatgtataataaagtaattaatattgtgcaagtgtaaaacacttctgttataaaagcagtgtttggaaaataagaaatattaaaaatggttacaaagtattagttaatttccttttcccactttcctccctttagctttagcagctaaagggtcaccaacttgtcattgcaagattcttagaaaatgtacttaatcttaaatacgctgagtactaaaaagtgtttatttcttatttcagtaagtgcggtaagttctattgagtacagagtacaagctgtaatcaaaggatggagaggacctttaccactgtatctcttaagctgtatgatttttctccagtttgttttatacaggttttgaatttctttaacttttattgtgtgtactgaatactgcatatgtattattctgattgtttgctctagtttactaccaataaaagtcctgttaatcacaagattgaagaaa

SEQ ID NO: 202020 - DNA, 2933 bp, Homo sapiens
  Payload ID: 19852
  Gene Name: zinc finger protein 281
  Uniprot ID: Q9Y2X9
  ENST ID: ENST00000367352
  CDS Start-End: 66-2645
atttttattaactggaggcgacggcggctgcggcggcggcgggacccccaggcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccaggccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgc

SEQ ID NO: 202021 - DNA, 3080 bp, Homo sapiens
  Payload ID: 19852
  Gene Name: zinc finger protein 281
  Uniprot ID: Q9Y2X9
  ENST ID: ENST00000367353
  CDS Start-End: 83-2770
gtggagaggacggcgttatttttattaactggaggcgacggcggctgcggcggcggcgggacccccaggcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccagggtatggttatgttcaaccaccgtcttcccccggtcaccagcttcacccggccggcggggtcggccgcccctcccccgcaatgcgtgttatcctcctctacctccgcagccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgcaaaaaaaaagacaaaaaaaaac

SEQ ID NO: 202022 - DNA, 1815 bp, Homo sapiens
  Payload ID: 19853
  Gene Name: zinc finger protein 282
  Uniprot ID: Q9UDV7
  ENST ID: ENST00000479907
  CDS Start-End: 41-1432
ttctccctggccgacccgagcggggaacagcactcccaggatgcagtttgtgtcaacacggccgcagcctcagcagctgggcatccagggcctggggctggacagcgggagctggagctgggcccaggctctgcccccggaggaggtctgccaccaggagccggcgctgcgcggggaaatggccgagggaatgccgcccatgcaggctcaagaatgggacatggacgcccggcggccaatgccttttcagttcccaccctttccagatagggcacctgtcttccccgaccgcatgatgcgagagccccagttgcccacagcagagatctcactctggactgtggtggctgccattcaggctgtggagaggaaggtggatgcccaggccagccagctgctgaacctggaggggcgcacggggacagccgagaagaagctggccgactgtgaaaagacggccgtggaatttgggaaccacatggagagcaagtgggccgtgctggggaccctgctgcaggagtacgggctgctgcagaggcggctggagaacttggagaacttgctgcgcaacaggaacttctgggtcctgcggctgcccccgggcagcaagggggaggcccccaaggttccagtgacttttgtcgacattgctgtgtacttctccgaagacgagtggaagaacttggacgaatggcagaaggagctttataacaaccttgttaaggagaactacaaaaccctcatgtccctggacgcggagggctcagtccccaagccagatgctccagtccaggctgagcccagggaagaaccttgtgtgtgggagcagcgccaccccgaagagagagaaatcccaatggatcccgaagcaggagcagagcccctggtgcctgcgcaggatgcgtcctcccaggtgaagcgtgaggacaccctgtgtgtccggggtcagcggggcctggaggaaagagccatccctacggaatccattaccgactccccaatttctgcccaggacctcttgtcccggattaaacaggaggagcatcagtgcgtgtgggatcagcaggatttggcagacagagatattcccacggatcccaattcagagtctctcatctcagcacatgacattttgtcatggatcaagcaggaggagcagccatacccatggggaccacgcgactcaatggacggagagcttggattagactctggccctagtgacagcctgctgatggtgaagaacccacccccggccccgccacagccccagccccagccccagccaccgcagccgcagctgcagtcgcagccccagccccagagcctgccccccatcgcggtggccgagaacccgggcggccccccgagccgagggctgctggacgacggtttccagccacaccaaggagcggccctacgagtgcgctgagtgcgagaagagcttcaactgccactcgggcctcatccgccaccagatgacgcaccgcggcgagcggccctacaagtgctcggagtgcgagaagacctacagccgtaaggagcacctgcagaaccaccagcggctgcacacgggcgagcggcctttccaatgtgcactgtgcggcaagagcttcatccgcaagcagaacctgctcaagcaccagcgcatccacacgggcgagcgcccctacacgtgcggcgagtgcggcaagagcttccgctacaaggagtcgctcaaggaccacctgcgcgtgcacagcggcggcccgggccccggcgccccacggcagctcccgccgcctcctgagcgagactagggctgggctgggggag

SEQ ID NO: 202023 - DNA, 3722 bp, Homo sapiens
  Payload ID: 19853
  Gene Name: zinc finger protein 282
  Uniprot ID: Q9UDV7
  ENST ID: ENST00000610704
  CDS Start-End: 106-2121
cctacgggctgtagatggagctgtccggccccggagagggggaaggcgcctggaaaacgttcttcttctccctggccgacccgagcggggaacagcactcccaggatgcagtttgtgtcaacacggccgcagcctcagcagctgggcatccagggcctggggctggacagcgggagctggagctgggcccaggctctgcccccggaggaggtctgccaccaggagccggcgctgcgcggggaaatggccgagggaatgccgcccatgcaggctcaagaatgggacatggacgcccggcggccaatgccttttcagttcccaccctttccagatagggcacctgtcttccccgaccgcatgatgcgagagccccagttgcccacagcagagatctcactctggactgtggtggctgccattcaggctgtggagaggaaggtggatgcccaggccagccagctgctgaacctggaggggcgcacggggacagccgagaagaagctggccgactgtgaaaagacggccgtggaatttgggaaccacatggagagcaagtgggccgtgctggggaccctgctgcaggagtacgggctgctgcagaggcggctggagaacttggagaacttgctgcgcaacaggaacttctgggtcctgcggctgcccccgggcagcaagggggaggcccccaaggttccagtgacttttgtcgacattgctgtgtacttctccgaagacgagtggaagaacttggacgaatggcagaaggagctttataacaaccttgttaaggagaactacaaaaccctcatgtccctggacgcggagggctcagtccccaagccagatgctccagtccaggctgagcccagggaagaaccttgtgtgtgggagcagcgccaccccgaagagagagaaatcccaatggatcccgaagcaggagcagagcccctggtgcctgcgcaggatgcgtcctcccaggtgaagcgtgaggacaccctgtgtgtccggggtcagcggggcctggaggaaagagccatccctacggaatccattaccgactccccaatttctgcccaggacctcttgtcccggattaaacaggaggagcatcagtgcgtgtgggatcagcaggatttggcagacagagatattcccacggatcccaattcagagtctctcatctcagcacatgacattttgtcatggatcaagcaggaggagcagccatacccatggggaccacgcgactcaatggacggagagcttggattagactctggccctagtgacagcctgctgatggtgaagaacccacccccggccccgccacagccccagccccagccccagccaccgcagccgcagctgcagtcgcagccccagccccagagcctgccccccatcgcggtggccgagaacccgggcggccccccgagccgagggctgctggacgacggtttccaggtgctgcccggggagcgtggctccggcgaggcgccgccgggtggggaccgcagcaccgggggcggcgggggcgatgggggcggtgggggcggcggcgcggaggcggggacgggggcaggcggcggctgtggcagctgctgccctggcgggctgcggcggagcctcctcctgcacggcgcccgcagcaagccctactcgtgccccgagtgcggcaagagcttcggcgtgcgcaagagcctcatcatccaccaccgcagccacaccaaggagcggccctacgagtgcgctgagtgcgagaagagcttcaactgccactcgggcctcatccgccaccagatgacgcaccgcggcgagcggccctacaagtgctcggagtgcgagaagacctacagccgtaaggagcacctgcagaaccaccagcggctgcacacgggcgagcggcctttccaatgtgcactgtgcggcaagagcttcatccgcaagcagaacctgctcaagcaccagcgcatccacacgggcgagcgcccctacacgtgcggcgagtgcggcaagagcttccgctacaaggagtcgctcaaggaccacctgcgcgtgcacagcggcggcccgggccccggcgccccacggcagctcccgccgcctcctgagcgagactagggctgggctgggggagggcagggccggacggagtggatcgggggcggcctgagcaccaaccaccttgccgggtgtcctcagccaccgtctggaaatcggcaacaggcattgcactccggttgggggtcccccagggtggggcagggatcccccagatctgtctggtctgaatggacgcccagctcatctagggtggacccagctgctggggaagagccagggggaccgcgaggagccgagcgtcctcgggcaccgccctcacacctcctcgagtgccctgggaccactgggccacagatggtcatcaggggaagccaccagggagtcccgaagcccttctgagatcaggaaatcaggtcccaaggttaggagacgccctgaaaaaaagcgaaggccgagggatgtgctaagggtaacaccttcatgatgacaacactgcctcgcgtttcaatagcgctttatacttttttaagtgttttctatccgttatccatttcacccttggcctatccctctcagataggtggggtaggattttcctggtgaccgagtaaagtgagaggcaggtgagacggttcacccaatcacacgggaaggggcgcgcgctgcccaaccgcgctctccgcctacctccgctgctcgggaagctgctggcctggccctcctggtctctcttcctttcctggtctctcttcctttccttgctctcacccacggataaaaccagaagcgacaggaggccagctcctggggttcctgggagccgggaacagattggctacggaacgccccaggttgtacattcagagggctctttctccatgggagctcctggtgccgcctcggccccagcctgtccccagcccctcaatctggtgcagcagcatcttgtcactgcacaacagtggcctggtcccccacaggcagttagggccccaggtcagacctcaccatgatgatttgttccagttctcccagggcagaggggcgagggagaggcttttgctgtgagagtagccgtcacgtgtctcttcccagcagcgccgggcaagtgggtgctagagtctgagcctcaggctctcctgccctgggcctcccaattggtgctatctgttactgcccgtgctcacggacatggatacagaccctgctgtgctccacaccctgcaggcgcctcgggaagcgcccaaaggattccccttcacgttggtgcacctgctccatagctccgggcgctgcgtcccgaggggccacagtctccatttcagcgtcttgcatggcctggcaccgggtggggtggtatgccccaggacccttgtttgtgtcaaaaatgactttccctgcccttgccgtgggtccggcgttcctcccagccgggatcacagtgggcagccggcacccggcaccactttggcgagcgtcctgcttccgccctcgccctcatctacgctgctccgctttcctcagacccctttttgccgtgcaaagggaattcttgacattaaataaaaggtatccagattgcagactgcatgttcacagagctgggggttctccagcttgcctacagtaaagcctcaatgaactggaatccaattcaa

SEQ ID NO: 202024 - DNA, 2297 bp, Homo sapiens
  Payload ID: 19854
  Gene Name: zinc finger protein 283
  Uniprot ID: Q8N7M2
  ENST ID: ENST00000324461
  CDS Start-End: 1-2040
atggagtctcgctctgtcgcccaggctggagtgcagtggtgcgatcttggctcactgcaagctccgcctcctgggttcacgctattctcctgcctcagcctcctgagtagctgggactacagttctggcttttctggattctgtgcttcaccaatagaggaatcccatggagcattaattagttcttgcaattccagaaccatgactgatgggttggtgacattcagggatgtggccatcgacttctctcaggaggagtgggaatgcctggaccctgctcagagggacttgtacgtggatgtaatgttggagaactatagtaacttggtgtcactggatttggagtcaaaaacgtatgagaccaaaaaaatattttcagaaaatgatatttttgaaataaatttttcccagtgggagatgaaggacaaaagtaaaacccttggccttgaggcatccatcttcagaaataattggaagtgcaaaagcatattcgagggactaaaaggacatcaagagggatacttcagtcaaatgataatcagctatgaaaaaataccttcttacagaaaaagtaaatctcttactccacatcaaagaattcataatacagagaaatcctatgtttgtaaggaatgtgggaaggcttgcagtcatggctcaaaacttgttcaacatgagagaactcatacagctgaaaaacactttgaatgtaaagaatgtgggaagaattatttaagtgcctatcaactcaatgtgcatcagagatttcatactggtgagaaaccctatgagtgtaaggaatgtgggaagacctttagctggggatcaagccttgttaaacatgagagaattcacactggtgagaaaccctatgaatgtaaagaatgtgggaaggcctttagtcgtggctatcaccttacccaacatcagaaaattcatactggtgtgaaatcttataaatgtaaggaatgtgggaaggcctttttttggggctcaagccttgctaaacatgagataattcatacaggtgagaaaccttataaatgtaaagaatgtgggaaggccttcagtcgtggctatcagcttactcagcatcagaaaatccatactggtaagaaaccttatgaatgtaaaatatgtggaaaggctttttgttggggctatcaacttactcgacatcagatatttcatactggtgagaaaccctatgaatgcaaggaatgtgggaaggcttttaattgcggatcaagtcttattcaacatgaaagaattcatactggtgagaaaccttatgaatgtaaagaatgtggaaaggcctttagtcgtggctatcacctttctcaacatcagaaaatccatactggtgagaaaccttttgaatgtaaggaatgtgggaaggcctttagttggggttcaagccttgttaaacatgagagagttcatactggtgagaaatcccatgaatgtaaagaatgcggaaagaccttttgtagtgggtatcaacttactcgacatcaggtatttcacactggtgagaaaccctatgaatgtaaggaatgtgggaaggcttttaattgtggatcaagccttgttcaacatgaaagaatccatacaggggagaaaccctatgaatgtaaagaatgtgggaaggcttttagtcgtggctatcaccttactcaacatcagaaaattcataccggtgagaaacctttcaaatgtaaggaatgtgggaaggccttcagttggggttcaagcctagttaagcatgagagagtccatactaatgagaagtcttatgaatgtaaagactgtgggaaggcctttggtagtggctatcaacttagtgttcatcagagatttcatactggtgagaagctttatcaacgtaaggaattcgggaagacctttacttgtggctcaaaacttgttcatgagagaactcatagtaatgataaaccctacaaatataacgaatgtggggaagcctttctgtggacaacttactcaaatgagaaaattgatactgatgaaaccttatgattgaaagttgtaaaagaatattttgtgtgtgtgtatagacaacttatcataataagaactcttactcttgagaaaccttgtgaatgtaagggttgtgcaaaagccattcatttctgtttatgggcaattatcttgctatccagcaattcatactagtgagaaatattttgaatataattaatatgaaaaggcctttagacttctgtacagtcttattggatatcaatttatactgatgtaaaatcatttaaatgtaa

SEQ ID NO: 202025 - DNA, 466 bp, Homo sapiens
  Payload ID: 19854
  Gene Name: zinc finger protein 283
  ENST ID: ENST00000590950
  CDS Start-End: 119-358
aaggttcttggactctgcatgtgctgccaggttgccagatttctaagaaggagtttgaagaggagaaaaggatttttgcatgtttagaaatcaaggttcaggagaatcttgacagtgaatgtgtctcattacattgaataacagctacaggatgttcgagagctgttctggcttttctggattctgtgcttcaccaatagaggaatcccatggagcattaattagttcttgcaattccagaaccatgactgatgggttggtgacattcagggatgtggccatcgacttctctcaggaggagtgggaatgcctggaccctgctcagagggactttagagatgaggtttcaccgtgttagccaggatggtctcaatctcctgacctcgtgatccacccacctcggcctcccaaaatgctaggattacaggtgtggcccaccgcacctggccaatgacaatctgtcttt

SEQ ID NO: 202026 - DNA, 298 bp, Homo sapiens
  Payload ID: 19854
  Gene Name: zinc finger protein 283
  ENST ID: ENST00000588967
  CDS Start-End: 163-298
cagtgctgccaggttgccagatttctaagaaggagtttgaagaggagaaaaggatttttgcatgtttagaaatcaaggttcagttctggcttttctggattctgtgcttcaccaatagaggaatcccatggagcattaattagttcttgcaattccagaaccatgactgatgggttggtgacattcagggatgtggccatcgacttctctcaggaggagtgggaatgcctggaccctgctcagagggacttgtacgtggatgtaatgttggagaactatagtaacttggtgtcactgg

SEQ ID NO: 202027 - DNA, 1260 bp, Homo sapiens
  Payload ID: 19854
  Gene Name: zinc finger protein 283
  ENST ID: ENST00000593164
  CDS Start-End: 98-382
tgctgccaggttgccagatttctaagaaggagtttgaagaggagaaaaggatttttgcatgtttagaaatcaaggttcaggagaatcttgacagtgaatgtgtctcattacattgaataacagctacaggatgttcgagagctgttctggcttttctggattctgtgcttcaccaatagaggaatcccatggagcattaattagttcttgcaattccagaaccatgactgatgggttggtgacattcagggatgtggccatcgacttctctcaggaggagtgggaatgcctggaccctgctcagagggacttgtacgtggatgtaatgttggagaactatagtaacttggtgtcactgggtaaggtcatctgcctgaaataatttagagtctcctctttgcatcatcagttttctgcactggaaattacagggctatctttgaagaaaccaggtgaatttcttctcccccttcccaagggcatgcttttatacttgctgggttagaaatgggtttgttaaacacgttgatcttccccatccctcagtgagctttacaccattctcgggccctccctgcaatcacctctctcctttaatggccaaggggctggatttgcattatagaacatttatttcataactatggcaaagaaaccagatttcataaattctgcaaatattatattgaatatctactcctggccagccttgtgctgagcactgtcaattgaatcatgaacaagctttgataacttgcccattttcgtgcagtttactttgtagtaaagcagaaacatcaaataagtaaatttataaatagataaatagtatgtaatgaagcaaattctttggaaaaggtaaacagcataagggaatagaaaatgatgaggactgacagggctaatttaggtaagacagtcggggaacgctttcttgaacagagatgtggagcctgggatctctatgtgaatatctggcggaggaacagatcagtcacagtgaacagcaaatgcaaagaccctgttgttggaaaggaactttaccagaactctagagtagagttattaaaggaacatgtactaagaaattaggccagggagataggaaggggccagataatacattgttttgttgttcttgtttgtggaatttggattgtttagtctctttcagtctgaaacagttcacatgtctttccttgacttgcgtatatgtctgtgatgcttttgaagattacaggccagctattttgtatagtg

SEQ ID NO: 202028 - DNA, 552 bp, Homo sapiens
  Payload ID: 19854
  Gene Name: zinc finger protein 283
  ENST ID: ENST00000593268
  CDS Start-End: 151-474
ccccagtgctgccaggttgccagatttctaagaaggagtttgaagaggagaaaaggatttttgcatgtttagaaatcaaggttcaggagaatcttgacagtgaatgtgtctcattacattgaataacagctacaggatgttcgagagctgatggagtctcgctctgtcgcccaggctggagtgcagtggtgcgatcttggctcactgcaagctccgcctcctgggttcacgctattctcctgcctcagcctcctgagtagctgggactacagttctggcttttctggattctgtgcttcaccaatagaggaatcccatggagcattaattagttcttgcaattccagaaccatgactgatgggttggtgacattcagggatgtggccatcgacttctctcaggaggagtgggaatgcctggaccctgctcagagggacttttttctgcactggaaattacagggctatctttgaagaaaccagatggagtcttgctctgtcacccaggctggagtgcagtggtgtgatctcggctcactgcaagctctgcct

SEQ ID NO: 202029 - DNA, 2428 bp, Homo sapiens
  Payload ID: 19854
  Gene Name: zinc finger protein 283
  ENST ID: ENST00000588797
  CDS Start-End: 549-2171
ctctgggtccaaactaaccacaggtctctgggtccttttccggtgtccttaaggttcttggactctgcatggttccctttagcctgtcttcgggcctgccacaattaaatgaccgcaagaaagaagtctatgctaagccccataatgaacgtttcaagcaagaaggatgagaattttagatctggaagtgtccgcgggacaggatcttgtcaagacctgatggggaagttctagagtgctgccaggttgccagatttctaagaaggagtttgaagaggagaaaaggatttttgcatgtttagaaatcaaggttcaggagaatcttgacagtgaatgtgtctcattacattgaataacagctacaggatgttcgagagctgttctggcttttctggattctgtgcttcaccaatagaggaatcccatggagcattaattagttcttgcaattccagaaccatgactgatatttggagtcaaaaacgtatgagaccaaaaaaatattttcagaaaatgatatttttgaaataaatttttcccagtgggagatgaaggacaaaagtaaaacccttggccttgaggcatccatcttcagaaataattggaagtgcaaaagcatattcgagggactaaaaggacatcaagagggatacttcagtcaaatgataatcagctatgaaaaaataccttcttacagaaaaagtaaatctcttactccacatcaaagaattcataatacagagaaatcctatgtttgtaaggaatgtgggaaggcttgcagtcatggctcaaaacttgttcaacatgagagaactcatacagctgaaaaacactttgaatgtaaagaatgtgggaagaattatttaagtgcctatcaactcaatgtgcatcagagatttcatactggtgagaaaccctatgagtgtaaggaatgtgggaagacctttagctggggatcaagccttgttaaacatgagagaattcacactggtgagaaaccctatgaatgtaaagaatgtgggaaggcctttagtcgtggctatcaccttacccaacatcagaaaattcatactggtgtgaaatcttataaatgtaaggaatgtgggaaggcctttttttggggctcaagccttgctaaacatgagataattcatacaggtgagaaaccttataaatgtaaagaatgtgggaaggccttcagtcgtggctatcagcttactcagcatcagaaaatccatactggtaagaaaccttatgaatgtaaaatatgtggaaaggctttttgttggggctatcaacttactcgacatcagatatttcatactggtgagaaaccctatgaatgcaaggaatgtgggaaggcttttaattgcggatcaagtcttattcaacatgaaagaattcatactggtgagaaaccttatgaatgtaaagaatgtggaaaggcctttagtcgtggctatcacctttctcaacatcagaaaatccatactggtgagaaaccttttgaatgtaaggaatgtgggaaggcctttagttggggttcaagccttgttaaacatgagagagttcatactggtgagaaatcccatgaatgtaaagaatgcggaaagaccttttgtagtgggtatcaacttactcgacatcaggtatttcacactggtgagaaaccctatgaatgtaaggaatgtgggaaggcttttaattgtggatcaagccttgttcaacatgaaagaatccatacaggggagaaaccctatgaatgtaaagaatgtgggaaggcttttagtcgtggctatcaccttactcaacatcagaaaattcataccggtgagaaacctttcaaatgtaaggaatgtgggaaggccttcagttggggttcaagcctagttaagcatgagagagtccatactaatgagaagtcttatgaatgtaaagactgtgggaaggcctttggtagtggctatcaacttagtgttcatcagagatttcatactggtgagaagctttatcaacgtaaggaattcgggaagacctttacttgtggctcaaaacttgttcatgagagaactcatagtaatgataaaccctacaaatataacgaatgtggggaagcctttctgtggacaacttactcaaatgagaaaattgatactgatgaaaccttatgattgaaagttgtaaaagaatattttgtgtgtgtgtatagacaacttatcataataagaactcttactcttgagaaaccttgtgaatgtaagggttgtgcaaaagccattcatttctgtttatgggcaattatcttgctatccagcaattcatactagtgagaaatattttgaatataattaatatgaaaaggcctttagacttctgtacagtcttattggatatcaatttatactgatgtaaaatcatttaaatgtaa

SEQ ID NO: 202030 - DNA, 5713 bp, Homo sapiens
  Payload ID: 19854
  Gene Name: zinc finger protein 283
  Uniprot ID: Q8N7M2
  ENST ID: ENST00000618787
  CDS Start-End: 298-2337
cttttaggggcggggcgagcttgcctgccagaagctcctctcccagcctgcgagcatttccaggctcttgtttcccatcagcctctgggtccaaactaaccacaggtctctgggtccttttccggtgtccttaaggttcttggactctgcatgtgctgccaggttgccagatttctaagaaggagtttgaagaggagaaaaggatttttgcatgtttagaaatcaaggttcaggagaatcttgacagtgaatgtgtctcattacattgaataacagctacaggatgttcgagagctgatggagtctcgctctgtcgcccaggctggagtgcagtggtgcgatcttggctcactgcaagctccgcctcctgggttcacgctattctcctgcctcagcctcctgagtagctgggactacagttctggcttttctggattctgtgcttcaccaatagaggaatcccatggagcattaattagttcttgcaattccagaaccatgactgatgggttggtgacattcagggatgtggccatcgacttctctcaggaggagtgggaatgcctggaccctgctcagagggacttgtacgtggatgtaatgttggagaactatagtaacttggtgtcactggatttggagtcaaaaacgtatgagaccaaaaaaatattttcagaaaatgatatttttgaaataaatttttcccagtgggagatgaaggacaaaagtaaaacccttggccttgaggcatccatcttcagaaataattggaagtgcaaaagcatattcgagggactaaaaggacatcaagagggatacttcagtcaaatgataatcagctatgaaaaaataccttcttacagaaaaagtaaatctcttactccacatcaaagaattcataatacagagaaatcctatgtttgtaaggaatgtgggaaggcttgcagtcatggctcaaaacttgttcaacatgagagaactcatacagctgaaaaacactttgaatgtaaagaatgtgggaagaattatttaagtgcctatcaactcaatgtgcatcagagatttcatactggtgagaaaccctatgagtgtaaggaatgtgggaagacctttagctggggatcaagccttgttaaacatgagagaattcacactggtgagaaaccctatgaatgtaaagaatgtgggaaggcctttagtcgtggctatcaccttacccaacatcagaaaattcatactggtgtgaaatcttataaatgtaaggaatgtgggaaggcctttttttggggctcaagccttgctaaacatgagataattcatacaggtgagaaaccttataaatgtaaagaatgtgggaaggccttcagtcgtggctatcagcttactcagcatcagaaaatccatactggtaagaaaccttatgaatgtaaaatatgtggaaaggctttttgttggggctatcaacttactcgacatcagatatttcatactggtgagaaaccctatgaatgcaaggaatgtgggaaggcttttaattgcggatcaagtcttattcaacatgaaagaattcatactggtgagaaaccttatgaatgtaaagaatgtggaaaggcctttagtcgtggctatcacctttctcaacatcagaaaatccatactggtgagaaaccttttgaatgtaaggaatgtgggaaggcctttagttggggttcaagccttgttaaacatgagagagttcatactggtgagaaatcccatgaatgtaaagaatgcggaaagaccttttgtagtgggtatcaacttactcgacatcaggtatttcacactggtgagaaaccctatgaatgtaaggaatgtgggaaggcttttaattgtggatcaagccttgttcaacatgaaagaatccatacaggggagaaaccctatgaatgtaaagaatgtgggaaggcttttagtcgtggctatcaccttactcaacatcagaaaattcataccggtgagaaacctttcaaatgtaaggaatgtgggaaggccttcagttggggttcaagcctagttaagcatgagagagtccatactaatgagaagtcttatgaatgtaaagactgtgggaaggcctttggtagtggctatcaacttagtgttcatcagagatttcatactggtgagaagctttatcaacgtaaggaattcgggaagacctttacttgtggctcaaaacttgttcatgagagaactcatagtaatgataaaccctacaaatataacgaatgtggggaagcctttctgtggacaacttactcaaatgagaaaattgatactgatgaaaccttatgattgaaagttgtaaaagaatattttgtgtgtgtgtatagacaacttatcataataagaactcttactcttgagaaaccttgtgaatgtaagggttgtgcaaaagccattcatttctgtttatgggcaattatcttgctatccagcaattcatactagtgagaaatattttgaatataattaatatgaaaaggcctttagacttctgtacagtcttattggatatcaatttatactgatgtaaaatcatttaaatgtaaggaatgtgtgaagatcttcattcatgacataaggtctgattaacatcaaataattggtatttgttaaaaagagtttaaataggaggaatgtgggaaggacctaaacttaattcagttcttgctgcacatcagagaattcatactgctgtgtaatcctatgcacataaggaatttgggaaggcttatagacacagtaaatatcttagagtacatcagagaattcatccaaatgagaaatcatttgaattagaattataggaaggcctttagacaaatgctacccaaattattatccagagactggtgcagtcataaaattgtcatctgtcaattgtgagataaacgtggaaagtgagtaaatatttggaacttttatagcaatttgacatttccataacattctgttttacaaaattatcagtccataaatgattgagaattgaaaacaaagtttgttctttcccagaaataatttgagacaagactcacacttttcaagacatgagacaagtgacaatttaaataagaaattcttcacttgcacctctctgattagaatagcagaatattcatactatagcaagatttggcaaatgagggaatcaaaattttctaatgcctgtaacagcataagataatttataccagatatgttaaatgtgcagaagccttccaacactattcagtctttgttaaacttcagtaagttcatcctagagagtaactctgttaatgtaacaaatgtaggaaaacccttatccatggcaaataccatactgtcatcaccatttcacctccatactacctgtaggatggtgagcaaaatgcttatctcttctggacatgatgtttcaaatgctgatggtaactaataatgctgttacagagattagatggatttagtatgcatcatatccttggaagagtatctggtatgtagcctatgcttaatacatattagctattgttcatattgtctttattattagtattactactggtgaattcttaggagaggcacaaccgttttgaggaatgaattcagaaaagcttcccataaccactcatccatttgaatttcagatagttcattctggataagatctagtacagtataaagaatttgaggggattttaattcagagtttatcccttaagctgagctaaaaaaatgagacttgaaaaaatccagacttttgaagagtttaggaaagctgttttatagaatgtcacacattagtttcattcctcatggtgaaatttgatatgggcctctccttcacatttctcgtaacatgaagttggaaatagaggcttaaacattttttaccagaacacttcatagatggtgatgtgtacttcatcttgcaatacctcagaagcagatagtatccatttcccccagtatcaccagtgccaagtttgatcacttatggtaactactggagttgtctgttataaagatccattatatacctaataggattggtcagccttgatcaatgatctttggaaatgtgtgatcatatggtatgtattttacttttttttttttttgggacaggatctctctttctgtcaccaaggctggagtgcagtggtgtgatttcggctcactgcaacctgcacctctcgggttcaagtgattctcgtgcctcagcctcccaagtagctggatacacaggtgtgcaccaccatactggctaattcttgtatttttagtagagatggggttttgccatgttggtccaggctgatcttgaactcctgcacctgcctcagcctcccaaagtgttgggattacaggtgtgagacactgcgcctggctatattttactatttggaaatcacaatgcatcttaaaattgatggcttcttgcaaccactttcaaccaggtgcctgtcatgatttagtgctagcatcaaggcaggttagttatgaagaaatagagtgtgtgtttatatactcacacagttagaaatcgacccttttaaaaattatttctttttgaaaataatgtcagttccatcagaactaatgcattgataactaaatgtctgtggttccttgtcataggtctacacctgacctctctattttgtgcacataggggattcgtaatatcactgttcagtcagtcattcaccatctagtgatcatcattctacatgattgcactttttcaaaggcataaaaagccaacagttgcactcttaataatcaactgtaacacaaagcagagtactttgggagttttaacaggatatattattggtaactggctattatgccactccctctgggtgccacatttgcctgttaaccaagaaatgtagacatggtgccttatcccaacatttctgaaattatatctcaaggaatcaccagtgcttactagtacttgacaatgaaggaggattttacagttaaagaagcttataaagtagcatctactaaatcccctcctaaggaacaagcaaaagcacctcaccagcttatcaaaagactaaagagaagtgaaaaaaaaaaaaagacggccgggcgcggtggctcatgcctgtaatcccagaactttgggaagccgaggcgggcggatcacgaggtcaggagatcaagaccatcctggctaacacggtgaaaccccgtctctactaaaaatagaaaaaattagccgggcgtggtggcgggcgcctgtggtcccagctactcggggaggctgaggcaggagaatggcgtgaacccgggaggcagagcttgcagtgagccgagattgcgccactgcactccagcctgggcgacagagcgagactccgtctcaaaaaaataaaaataaaaaaagactaaggagtattctagtgaagaaaatggttgaactttgtttaaactggtgtatggcaaacttcactgttgaaatacttattcccatgacctattatctttgtaggtgggtgaaattgcattgggaactgctgctataaccaaaagagaatttcagtcaccatgtctggttgttagctatgatggaatggcagcatcatggtctcagttatgagtgaaaatctttgttgtagctaagtagtggtgcctcctgagttttattaaatgccgtttcactatc

SEQ ID NO: 202031 - DNA, 4351 bp, Homo sapiens
  Payload ID: 19855
  Gene Name: zinc finger protein 284
  Uniprot ID: Q2VY69
  ENST ID: ENST00000421176
  CDS Start-End: 217-1998
gggggcgaggttgctgcagtgcattcggtggtagtttggtgtcagtcctgtgtcttgtcggtccttctaaacgtgtccccttacgatgctggctcgcaaccacctggaagttgactaaggggagaaggagtctcgttggaaaacggaggcacaattctgtcttctcttgaactgcataactgagaactctgcaaattccccaaagaaggaggaaaaatgaccatgttcaaggaggcagtgaccttcaaggatgtggctgtggtcttcaccgaggaggagctggggctgctggacgtttcccagaggaagctgtatcgagatgtcatgctggagaacttcagaaacctgctatcagtggggcatcaactttcccaccgagatacttttcacttccaaagagaagaaaagttttggatcatggagacagcaacccaaagagaagggaattcaggaggcaagatccaaactgagttggagtctgttccagaaacaggaccacatgaagagtggtcttgccagcaaatctgggaacaaactgcaagtgagttaactagacctcaagactccataagtagctctcagttctccacacaaggtgatgtcccctcccaggttgacgcaggactatctataattcacataggagagacaccttctgagcatgggaagtgtaaaaaattcttcagtgatgtctccatccttgatcttcatcaacaattacactcaggaaagatatcccatacatgtaatgagtacaggaagagattctgttatagctcagctctttgtcttcatcagaaagttcacatgggagagaaacgctataagtgtgatgtgtgtagtaaggcatttagtcagaactcacaactgcaaactcatcagagaatccacactggagagaaaccattcaaatgtgagcagtgtgggaaaagtttcagccgtagatcaggaatgtatgttcattgcaaattacacacaggagaaaaacctcatatttgtgaggaatgtgggaaggccttcattcacaattcccagcttcgggaacatcaaagaatccatactggggagaagccattcaaatgttatatatgtggtaagagcttccatagtagatcaaatcttaataggcattccatggtccacatgcaagagaaatcatttagatgtgatacctgtagtaatagctttggtcagagatcagcacttaatagtcattgcatggaccacacaaaagagaaactatacaaatgtgaagaatgtggaaggagcttcacttgtaggcaagatctttgtaagcatcagatggaccatacaggagacaaaccatataattgtaatgtatgtgggaagggcttcaggtggtcctcatgtctttcaagacatcagcgggtccacaatggagaaacaacattcaagtgcgacggatgtgggaagagattttatatgaattcacagggccattcacatcagagagcctatagagaagaagaactgtataaatgtcagaagtgtgggaagggctacattagtaagtttaatcttgacttgcaccagagggtccacacgggagagagaccttataattgtaaggaatgtggaaagagcttcaggtgggcctcaggtattttgagacataagagactccatactggagaaaaaccattcaaatgtgaagagtgtgggaagaggtttactgagaattcaaaacttcgtttccatcaaagaattcacactggagaaaagccttacaaatgtgaggagtgtggaaagggattcagatgggcctcaactcatctaacccatcaaagactccacagcagagaaaaactattccaatgtgaggattgtgggaagagcagtgagcacagttcatgccttcaagaccaacaaagcgaccacagtggagaaaaaacatccaaatgtgaggactgtgggaagcgctacgagaggcgcttgaatctagatatgattttatcattatttttaaatgatatataattattgtccatatttatgggttacagcatatttcaatacatgtatacaatgtataatgatcaaatcagtgttattagcatatccatcacctcctttatcatttatttgtggatcatttatcatttctttgtgctttgaacgttcaaaaactgctgttctagttatttgaaaataagttattattaattatagtcacctttagtgctgtggaacactagaacttgttcctttcatcatcttactgtactttcatatctgttaacgaatctttcatcatccaccctctctcctacttttcccttctagtaattgctatgccatgctgcttctgcttttttttttttttttttttttttttgagaacagagtcttccaggcttgagtgtagtggcatgatcctttctcactgcagcctccacctcctgggttcaagcgattctcctgcctaaacctcctgagtagcagggattacaggcacgcaccaccacgcccagctaatttttgtacttttttttttttttttttgagacagagtatcgctctgtcgcccagtatggagtgcaatggcttgatctcggctcactgcaacctctgcctcctgggttcaaacgattcttccctgccttggcctcccgagtagctgggactacaggcgcccgccaccacacctgactaattgttgtatgcgtagtagagatggggttttgccatattggccaacctggacttgaactcctgacttcagatgatccgcccacctcggcctcccaaagtgctgggattacaggcgtgagccaccatgcccaccatgcctaaaaatttttgtatttttagtgaagatggggtttcaccacattggccaggctagccttgaactcccaaactcaaatggtccacctgccttggcctcccaaagtgctgggattacaggcatgagccaccgtgcccagccaatgctatgctgcttctatgatgtcaactttttagcttccacatatgtgtgaaaacatgtggtatttatctttctgggcctgaatttacatcactcaacatcatgttctccaaagcttatctttatcttgccataaatgacagaattttattattttttatggttaaatagtgtacctttgtgtatgtatgccacattttctttaccattttctgttgatgaacacttagattggttccatatgttagctattgcaaatagtactataataaatataggagtgcagataggagttcaacacactgatttcctttcctttggatatacagctagtagtgggattgctggatcacttgaatgctgatatgcataagaggatctacactggagaaaaaccatggaagtgtggagattgtggtacatgcttcagtcagggctcacatcttcaaattcagtgtctgttctgtagagaaaccttaataatgtgatatatgtgacagcaaagagttataagatatgaatatgttaattttagtagatacttccgaaaagtatttcaaactggttgtaccactataaactctgaccattattaggcaagaattggctttttttttttttttcttttgagacagtcttgctctgtcacccagactggcatgcagtggaatgatcacggctccctgcagccttgacctcccaggctcaagaaatccttctgcctcagcccctcaaaagctgggactataggcatgcaacaacacgcctggctaaatttttgttgtagagatggggtctcactatgttgcccaaattggtctcaaactcctgggctcaagcgattctccctcctcagccttccaaagtgctgggattacaggcctgagccatgcgcacagcattttgttttgttttgttttgtttttgagatggggtctctcggtgttgcccaggctggattgcttattcacagatgcagttacagtgccctatagcctcgaactcctgggcctaagtgatcctcttgcttcaatcccctgagaagctgggactacaggcatggaccaccacccctgattgatcttctttagtttctataacaaaatagtacactgtttccacaaacttgggaaggctagtatttgggggtggggggcgtggaaatcactaaacaacaaagaaaatctgatgaattggacagcataaaaatattggcataaagatgaacataacataagcaggaatatttaaagcacatactttttatagagtgtctcccctgtaatgtctctggttaaatgaaagggtttcaaatgtgaagacaaccctaaccatactcattatctgtaaaagatgtagcattgtcatggactccttaataaacgtgaagactttaatcca

SEQ ID NO: 202032 - DNA, 2793 bp, Homo sapiens
  Payload ID: 19856
  Gene Name: zinc finger protein 285
  Uniprot ID: Q96NJ3
  ENST ID: ENST00000544719
  CDS Start-End: 198-1970
gacgctggggtgagtcccgtctgtaccgcgcccctcttggaggcgtagccaggagtaggagtgtaggatgtgcagctgtgacccgtccctgtggactgaagtaggaggagtggaagaggggactggtaaccaatgataaggcctcgtaggtgggttctgcttttccagaatcctgccctttccaaaaggaagacggtatgattaagttccaggaaagggtgacattcaaggatgtggctgttgtcttcaccaaggaagagctggcactattggataaagcccagataaacctgtaccaagatgtgatgctggaaaacttcaggaacctcatgttagtgagagacgggattaaaaacaacattttgaatcttcaggcaaaggggttaagttacctttcgcaagaagtgcttcattgctggcagatttggaaacaaaggatccgggatttaactgtgagtcaggattatatcgtgaaccttcaagaagagtgttccccacatttagaagatgtttccctcagtgaagagtgggcaggcatttctcttcagatttctgaaaatgaaaactatgtagtaaatgccattatcaaaaatcaagatatcacagcatggcaaagcctgacacaggttcttaccccagaatcgtggaggaaagccaacataatgaccgagccccagaactctcagggaagatataagggaatttacatggaagagaaattgtacagacgtgctcagcatgatgacagcctcagttggacctcatgtgatcatcatgagtcccaagaatgtaaaggagaggaccctggtagacatcccagctgtgggaaaaacttgggtatgaaatcaacggttgaaaaacgtaatgcggcccatgtattaccacagcctttcccatgtaataactgtggggtggcctttgcagatgatacagatcctcatgtccatcacagcactcacctaggagaaaaatcttataaatgtgaccagtatggaaagaactttagtcagagccaagatcttatcgttcattgtaaaactcactctggcaagactccctatgaattccacgaatggcctatgggctgcaaacagagctcagaccttcccagatatcagaaagtctcctcaggagacaaaccctacaaatgtaaagaatgtggcaagggcttcaggcgcagctcttcccttcacaaccatcatcgagtccacacaggggagatgccctacaaatgcgatgaatgtgggaaagggtttggatttaggtcacttctttgtattcatcagggagtacacacagggaaaaagccctataaatgtgaagagtgtgggaagggctttgatcagagctccaaccttcttgtccatcagagagtccacactggagagaagccctacaaatgcagtgagtgtggcaagtgctttagttcaagctccgttcttcaagtccactggaggtttcacacaggggagaaaccatataggtgtggtgagtgtggaaagggcttcagccaatgtacacaccttcacattcaccagagagtccacacaggggagaaaccatacaaatgcaatgtgtgtggaaaggattttgcgtatagctctgttcttcacactcatcagagagttcacactggagaaaaaccatataaatgtgaagtgtgtggaaagtgcttcagttacagttcatattttcacttacatcaaagagatcacatcagagagaaaccatataaatgtgatgagtgtggtaaaggcttcagccggaattcagatcttaatgttcacctcagagtccacacaggagagaggccctataagtgtaaggcatgtggtaagggcttcagtcgtaattcatacctccttgcccatcagagagtgcatatagatgagacacagtacacacactgtgagcgtggaaaggaccttctgactcatcaaagactacatgagcagagagaaacattataaatgtagtaagtcagggttcaattagtaaaacagaagccacactgtattccagatgatagaggcttactcagcctgtgggagggctaggggagcaaaagacagggacactgccatcgataatgtcagcctgcagcactgaagtgtgccaggcaaggactgtggatttcaagaacttctgtgaagctcccatcaactgctgtatgctacaatggcaaagaggttacttttgacaaatgggtggtttgtggtagtggttgtagttagtggtcaaatttccattaaagggtgtgtccaggaaggaaattctaattgggatgatcatggtaaggtcttcagttcagccaacgtctttagatttttttttagtccccagtagaaaaatactctctgtatgaagaacattcaaaagtgtgctcaaaaatgaaacccatgctcttactatgaaagaacgttagtacccaggttttccatgagattctctacacaggcaagaagctccatagaagtggcatttgaagggtgtggcagaggcagtgctgtgtttatcacactggttccatttccttgcaaataagaagtctatttcccagtaacccttgcagttaagagtgtgcccatgtgattgagttctagccaatggagtgtgagcaaaagtgatataagccactttcaggtctagcctttacaaacatcctcaggcttctctatccctgccaaggtgaccttggaggctgcttattccagactgggttgatagaaggtcactacttcatctgtgttggatttctttttagagtaagaaataaaagttcattgtgtctca

SEQ ID NO: 202033 - DNA, 2388 bp, Homo sapiens
  Payload ID: 19856
  Gene Name: zinc finger protein 285
  ENST ID: ENST00000591679
  CDS Start-End: 52-1845
acgctgggttctgcttttccagaatcctgccctttccaaaaggaagacggtatgattaagttccagattcaagggatacatgtgcaggaaagggtgacattcaaggatgtggctgttgtcttcaccaaggaagagctggcactattggataaagcccagataaacctgtaccaagatgtgatgctggaaaacttcaggaacctcatgttagtgagagacgggattaaaaacaacattttgaatcttcaggcaaaggggttaagttacctttcgcaagaagtgcttcattgctggcagatttggaaacaaaggatccgggatttaactgtgagtcaggattatatcgtgaaccttcaagaagagtgttccccacatttagaagatgtttccctcagtgaagagtgggcaggcatttctcttcagatttctgaaaatgaaaactatgtagtaaatgccattatcaaaaatcaagatatcacagcatggcaaagcctgacacaggttcttaccccagaatcgtggaggaaagccaacataatgaccgagccccagaactctcagggaagatataagggaatttacatggaagagaaattgtacagacgtgctcagcatgatgacagcctcagttggacctcatgtgatcatcatgagtcccaagaatgtaaaggagaggaccctggtagacatcccagctgtgggaaaaacttgggtatgaaatcaacggttgaaaaacgtaatgcggcccatgtattaccacagcctttcccatgtaataactgtggggtggcctttgcagatgatacagatcctcatgtccatcacagcactcacctaggagaaaaatcttataaatgtgaccagtatggaaagaactttagtcagagccaagatcttatcgttcattgtaaaactcactctggcaagactccctatgaattccacgaatggcctatgggctgcaaacagagctcagaccttcccagatatcagaaagtctcctcaggagacaaaccctacaaatgtaaagaatgtggcaagggcttcaggcgcagctcttcccttcacaaccatcatcgagtccacacaggggagatgccctacaaatgcgatgaatgtgggaaagggtttggatttaggtcacttctttgtattcatcagggagtacacacagggaaaaagccctataaatgtgaagagtgtgggaagggctttgatcagagctccaaccttcttgtccatcagagagtccacactggagagaagccctacaaatgcagtgagtgtggcaagtgctttagttcaagctccgttcttcaagtccactggaggtttcacacaggggagaaaccatataggtgtggtgagtgtggaaagggcttcagccaatgtacacaccttcacattcaccagagagtccacacaggggagaaaccatacaaatgcaatgtgtgtggaaaggattttgcgtatagctctgttcttcacactcatcagagagttcacactggagaaaaaccatataaatgtgaagtgtgtggaaagtgcttcagttacagttcatattttcacttacatcaaagagatcacatcagagagaaaccatataaatgtgatgagtgtggtaaaggcttcagccggaattcagatcttaatgttcacctcagagtccacacaggagagaggccctataagtgtaaggcatgtggtaagggcttcagtcgtaattcatacctccttgcccatcagagagtgcatatagatgagacacagtacacacactgtgagcgtggaaaggaccttctgactcatcaaagactacatgagcagagagaaacattataaatgtagtaagtcagggttcaattagtaaaacagaagccacactgtattccagatgatagaggcttactcagcctgtgggagggctaggggagcaaaagacagggacactgccatcgataatgtcagcctgcagcactgaagtgtgccaggcaaggactgtggatttcaagaacttctgtgaagctcccatcaactgctgtatgctacaatggcaaagaggttacttttgacaaatgggtggtttgtggtagtggttgtagttagtggtcaaatttccattaaagggtgtgtccaggaaggaaattctaattgggatgatcatggtaaggtcttcagttcagccaacgtctttagatttttttttagtccccagtagaaaaatactctctgtatgaagaacattcaaaagtgtgctcaaaaatgaaacccatgctcttactatgaaagaacgttagtacccaggttttccatgagattctctacacaggcaagaagctccatagaagtggcatttgaagggtgtggcagaggcagtgctgtgtt

SEQ ID NO: 202034 - DNA, 555 bp, Homo sapiens
  Payload ID: 19856
  Gene Name: zinc finger protein 285
  ENST ID: ENST00000589738
  CDS Start-End: 78-248
gcacgctgcgggcgacattgtttgggacgctgggttctgcttttccagaatcctgccctttccaaaaggaagacggtatgattaagttccagattcaagggatacatgtgcaggaaagggtgacattcaaggatgtggctgttgtcttcaccaaggaagagctggcactattggataaagcccagataaacctgtaccaagatgtgatgctggaaaacttcaggaacctcatgttagtgagtgagtaactgagcatgagaccactggacctgtttcctcaaatcatcatttcaaaccagatagaatattccagttagaccacaaagagaaactttggccactggaaagaaaactcctaagagatgcatgtgcaggagacgggattaaaaacaacattttgaatcttcaggcaaaggggttaagttacctttcgcaagaagtgcttcattgctggcagatttggaaacaaaggatccgggatttaactgtgagtcaggattatatcgtgaaccttcaagaagagtgttccccacatttagaagatgtttccctcag

SEQ ID NO: 202035 - DNA, 540 bp, Homo sapiens
  Payload ID: 19856
  Gene Name: zinc finger protein 285
  ENST ID: ENST00000585868
  CDS Start-End: 423-540
actggacgcacgctgcgggcgacattgtttgggacgctgggttctgcttttccagaatcctgccctttccaaaaggaagacggtatgattaagttccaggagacgggattaaaaacaacattttgaatcttcaggcaaaggggttaagttacctttcgcaagaagtgcttcattgctggcagatttggaaacaaaggatccgggatttaactgtgagtcaggattatatcgtgaaccttcaagaagagtgttccccacatttagaagatgtttccctcagtgaagagtgggcaggcatttctcttcagatttctgaaaatgaaaactatgtagtaaatgccattatcaaaaatcaagatatcacagcatggcaaagcctgacacaggttcttaccccagaatcgtggaggaaagccaacataatgaccgagccccagaactctcagggaagatataagggaatttacatggaagagaaattgtacagacgtgctcagcatgatgacagcctcagttggacctcatgtgatcatcatgagt

SEQ ID NO: 202036 - DNA, 6012 bp, Homo sapiens
  Payload ID: 19856
  Gene Name: zinc finger protein 285
  Uniprot ID: Q96NJ3
  ENST ID: ENST00000614994
  CDS Start-End: 66-1838
cgacattgtttgggacgctgggttctgcttttccagaatcctgccctttccaaaaggaagacggtatgattaagttccaggaaagggtgacattcaaggatgtggctgttgtcttcaccaaggaagagctggcactattggataaagcccagataaacctgtaccaagatgtgatgctggaaaacttcaggaacctcatgttagtgagagacgggattaaaaacaacattttgaatcttcaggcaaaggggttaagttacctttcgcaagaagtgcttcattgctggcagatttggaaacaaaggatccgggatttaactgtgagtcaggattatatcgtgaaccttcaagaagagtgttccccacatttagaagatgtttccctcagtgaagagtgggcaggcatttctcttcagatttctgaaaatgaaaactatgtagtaaatgccattatcaaaaatcaagatatcacagcatggcaaagcctgacacaggttcttaccccagaatcgtggaggaaagccaacataatgaccgagccccagaactctcagggaagatataagggaatttacatggaagagaaattgtacagacgtgctcagcatgatgacagcctcagttggacctcatgtgatcatcatgagtcccaagaatgtaaaggagaggaccctggtagacatcccagctgtgggaaaaacttgggtatgaaatcaacggttgaaaaacgtaatgcggcccatgtattaccacagcctttcccatgtaataactgtggggtggcctttgcagatgatacagatcctcatgtccatcacagcactcacctaggagaaaaatcttataaatgtgaccagtatggaaagaactttagtcagagccaagatcttatcgttcattgtaaaactcactctggcaagactccctatgaattccacgaatggcctatgggctgcaaacagagctcagaccttcccagatatcagaaagtctcctcaggagacaaaccctacaaatgtaaagaatgtggcaagggcttcaggcgcagctcttcccttcacaaccatcatcgagtccacacaggggagatgccctacaaatgcgatgaatgtgggaaagggtttggatttaggtcacttctttgtattcatcagggagtacacacagggaaaaagccctataaatgtgaagagtgtgggaagggctttgatcagagctccaaccttcttgtccatcagagagtccacactggagagaagccctacaaatgcagtgagtgtggcaagtgctttagttcaagctccgttcttcaagtccactggaggtttcacacaggggagaaaccatataggtgtggtgagtgtggaaagggcttcagccaatgtacacaccttcacattcaccagagagtccacacaggggagaaaccatacaaatgcaatgtgtgtggaaaggattttgcgtatagctctgttcttcacactcatcagagagttcacactggagaaaaaccatataaatgtgaagtgtgtggaaagtgcttcagttacagttcatattttcacttacatcaaagagatcacatcagagagaaaccatataaatgtgatgagtgtggtaaaggcttcagccggaattcagatcttaatgttcacctcagagtccacacaggagagaggccctataagtgtaaggcatgtggtaagggcttcagtcgtaattcatacctccttgcccatcagagagtgcatatagatgagacacagtacacacactgtgagcgtggaaaggaccttctgactcatcaaagactacatgagcagagagaaacattataaatgtagtaagtcagggttcaattagtaaaacagaagccacactgtattccagatgatagaggcttactcagcctgtgggagggctaggggagcaaaagacagggacactgccatcgataatgtcagcctgcagcactgaagtgtgccaggcaaggactgtggatttcaagaacttctgtgaagctcccatcaactgctgtatgctacaatggcaaagaggttacttttgacaaatgggtggtttgtggtagtggttgtagttagtggtcaaatttccattaaagggtgtgtccaggaaggaaattctaattgggatgatcatggtaaggtcttcagttcagccaacgtctttagatttttttttagtccccagtagaaaaatactctctgtatgaagaacattcaaaagtgtgctcaaaaatgaaacccatgctcttactatgaaagaacgttagtacccaggttttccatgagattctctacacaggcaagaagctccatagaagtggcatttgaagggtgtggcagaggcagtgctgtgtttatcacactggttccatttccttgcaaataagaagtctatttcccagtaacccttgcagttaagagtgtgcccatgtgattgagttctagccaatggagtgtgagcaaaagtgatataagccactttcaggtctagcctttacaaacatcctcaggcttctctatccctgccaaggtgaccttggaggctgcttattccagactgggttgatagaaggtcactacttcatctgtgttggatttctttttagagtaagaaataaaagttcattgtgtctcaccactgagatttttggtggtttatttattactgcagcattgcctaggctatcctgactagcatggagggattttatagcaatatgtttcattgtcattggagtccacatacagaagtaacataattcagagttcaaaacttttaaatctttaaggcttgatgtggcagtgcaaccatctaaaatggtatggatgggacttcttcagtgataaccttcattcattggtgagtacaccaaagagaaatgttccagatgatatagctgtggtaaaactttactgaaaagtataacccaccgacgtaagaaatctcatataatagagaaactctataatgtgggatgctgaataggtttgtcagctcacaccttaaatgcgattaaaaattaactagaataggtgttctgtggttagtcttaataaaattaattgaataaaatcaacatttactaaagtgaccaacaacatgtaaaaaaccaacagtgttcattgcagactgatgcagtcttcttctcagcagacctgtataataatgggtttttaaaggatgctctttctgtcagtttccccccaaatttgtcatttaattggggataatagatgaattcgagaggagatctctttgctttttttttttttttttttttttggaaacagggtcttgctgtgtcacccaggtggctggagtgcagtggcctgatcattgctcgctgaagccttgaactcctggcttcagtgatcctcctgcctcagcctcctgagtagctgggactacagacatacaccaccgtgttcagctgatgttttctttaaaaattgtacttgtagagatggggtcttactttgttgcccaggttagtctcaaacttctggtttcaagcgatcctcctacctcagcttcccaaagtgcagggattacaggtttgggccactgcactcatcccacaaggtgttttttttttccttcaaaaacagtgtccttttttgttttaattgacttataggtttcttcatttggatcatggtttattcctagtttttcttgcattacagtttcctgctagttatagtttgtaaacagaacagccattcaagtgcaaataaaaccatccctgaagtgtcattttcttactgatcaggtggataatagtgaaatattttaaaaattctatgtcagtagaaatgaggaaatgagtgttcttacataagttggtgggggaaagaaaaacaggtacaaagttgctggagaggatcttgtctatatgtatcatatgtacaatgtgcattgtctttgagccaatgatcctgcttctcagaatgtatttttaggatgtaattacatgagtggggaaaatatggtttcagaaagaaatatgttctaagaattttgcaatgagaagactgtaaacaacctgaaggttcatgtataagagattgagtaaattagggcatcccatataatggaataacatggctccatcaacaatgatctagacctataaaaatgtccacatgttattgtccatgtccaccacatactccagtactcctacttgcaaacattaagttagagaaaaaatccgggatacacattatcctaggaagcttttggggtttagaatgggtgcaacattccttcatgacagaatcagccctcagtgttggtggaggtgtcccaggcaatcctctagtttggccgggagcagcgcttgcatatcacattaagctttttaaatatatgatgctaacaggaatgtctccctacttcacaaaattgtttgcttttcctcttgtagcaaagtagcatggaaaaagcagaaattagtctagctcccaatcagtgggagccaatctcatttacaaatgaagatgcagagatcctaaataaatatgagcatgtcaaatccaatgatttgataaaagcgtaacagactcgctcatgtataatttatcctaaatatgcttatcagcttctgcctcataacacacacaagaactgagtagctctaaatacatatttatttagctcatgatgtgtgagctggcaagttcaactgggcttagctgggcagttctggtgtgggacatgctagattatcttaactgggctttgtacatgcatctgcagtcagctgatggttcatctgggcctggctgttttatgatggtcatagatgagacaacgaagttctctctgtcatcatggtctctcaccctccagaagaccaatcgagggttggtcccatagtgccagggtttcaagggcaaaagctgtgatctcttaaggcctcatcagggaacaggctcaatgatactttcaccacattttaatgattaaagcaagtcacaacactggcccagattcatggggtgagattaagacaaaataaaaaatgttgagacataatcattggaaggaaaaggaagatactatttttatgctagagaataatgttatttacttataaaattcaaatccacctgtaaaatttgaccaattgaaggctgttttaaaattatcgggtcaacaaattggtttcacacgaaattggcatgtgaaaattcatagcattactatgtaagagtcttttataaaatgtagccaaaatgtttcattcacaataacaattgtgtgcaatgaccagaattgtccaaaggtaattctgggagttccctttgggatgcctaggtgaggagctatctggggcctcagactcccacattcttcagtgggaagggctttacatgaactcaacttcccagcggctttctcttcctgatgggaggtgttagaacctggctttctcatgcaacttctgtgaagctctgacaactaaagccagattgtctgctttagttaagtagtccagattacctgcatagtcaatttgttccctcaccaacatggatgccttcacaattgctctttaagaaggataaaaacatagcggtgaggtgtggtctatttcctgcttcacccaggccctggtgcttcttcaagtggtatgagaaattgtggtcctgtgccttctcttccagacccttagcttacatgttttccctataaaacttagtcctaatcccagcactttgggaggccaaggtggctgaatcacaagatcaggagtttgagaccagcctggccaacatagtgaaaccccgtctctactaaaaatacacaaaattagctgggcatagtggcaggcacctgtaatcccagctactcaggaggctgaggcaggagaatcgcttgagcacaggaggtggaggttgcaatgagccaagatcgcaccactgcactccagcccaggcgacagggcaagactctgtctcaaaaaaaaaaaaaaaaaaa

SEQ ID NO: 202037 - DNA, 654 bp, Homo sapiens
  Payload ID: 19857
  Gene Name: zinc finger protein 286A
  ENST ID: ENST00000395893
  CDS Start-End: 198-623
aggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagcagttgcagtgatcatcctttttttgattccttatgttcatcttgagagctggtttagggagataactggaagaagaattagtaggtcttaaatcatcacatgtttagctttactaggaactg

SEQ ID NO: 202038 - DNA, 5443 bp, Homo sapiens
  Payload ID: 19857
  Gene Name: zinc finger protein 286A
  ENST ID: ENST00000395894
  CDS Start-End: 322-672
caaagaagttcgtcccctttgtgaggcccgggatgggaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagaactgcctttttgttgagcacagaaaacgaaggaaatttgcatttccaatgtctttcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaatgtaagttggttttatcactgtattaaatacttgagtgtttaggtggaaggcgcatccataatatgcatgtgaggaccaattctgtatgcatctaatttcatttgcgtaatacatagttttgagccataagcaggttctttatgtccgttaatttgataattatgaaatctagccagcgatttcaaaattttaatctccaacgtcccaaatagctatctgtggaaattcaagaagtccctgagagtaggtagcagtacgaacattgtgaaatccagttttcccctctcttgtttatgtcagagctttgttgtaagcctctcactttgtaaggaaattcttattgggtaggttaggctgagggcttacatccttatcatcaggaagacacaatgttgttatttattactccttgagatctagatacacatatggtataattcatctagagtgtaatttcttttatattagccttaaaaaccaaaaatgctgggttcaaagtccttagaattcccttcctccctcaacaagctgctgtctatgttgatgaccataactgggatgtataatatttacagacaactctaagttacgttcacatggattatgtacatcattgatttttttttttttttttttttgagacagagtcttgctctgttgcccgggctggagtgcagtggcgcgatctcggctcactgcaacctccacctcccaggttcatgccattctcttgtctcagcctcccaagtagctgggactacaggcacctgccagtacgcctggctaattttttttgtatttttagtagagatggggtttcaccatgttagccaggatggtcttgatctcctgacctcgtgatctgcctgcctcggcctcccaaagtgctgggattacaggcatgagccaccatgcctggcatcatcattgatttatgtcattgttatccctctaccgcggagaccttctttcattttccatttccctgggagttcacgtgaagtagtgaatgggtcaaaatcttaacagtggttgttgatcaagtccttcctttcttatccttggcactgaataaatctttggttttccataatcaaagggtgagggagacttcttttgtctacattattcagctttctgaaagctatgctgtgtccatttgagaaaaagccccagggatattgaaggtctgagaagttgagtggttcagtgtgttattatatttagggtcccagtaaagaagaactgaagcaactgtgagacaccagggcatacttccctgtatgagtggaaaacaaggcacggaaaatagctcacaggatagtcctcaactgacttgcttgaggataagcagcttcccttcgtgaagaagttgccatttctctggccttcatatttatctactttttgttattgttgtctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgcgtggtccagtcaccttgcaccaggccccacctcccacattggggattacaattaaacatgagatttgggtggggatacagatctaaactgtatcattactcaaaaaaaaaaaaaaaaagaaagaaaagaaaacacaggaaaaggaactcacctcttttatcatcttagtatttagtactaatggtttagagcaggaattgacaaactgtggcctggactcatggaccaactctggcccaccacctgtttctcagaagaaaattttattggaactcagccacacttactcatttacatgttgtccttgactgcctttgtgtccagtgtcagaactgagtagctgcagcggaggttgtgcctctgggctttaatatcacaaacagagcagcttataagcaacagaaacttacttctcacagttttggaggctgggaagtccaagatcaaggtgtcaacatatttagggtctagggaaggtctgcttcttggttaatagaaagcacctttcactgtgtcttcacatggtagaaggggagagctctggtatcttcagccccttataagggcactaatcccattcatgagagctccaccctcacgacctaatcacctccaaaaggccccatttcgtaataccgtcagttaagtttcattatatgactttgatggggatatagcccatagtaggttgtatgtccctgaaagcctaaaatatttactgtttggctctttacagaaaatattttcttggcccctgttccagagcattcatcaagtcagataaagggtttaaaccagtcagagaaactaggtggaatggaaaagtactgagagataattggggacagaaaaataaaagagatgggaaatgctgcatcaaaatactcctacctctaggatgttactatatattgttaggagaattcaagttattgaaacttgccaaattcttgagtgaagaggaattcatttgagagccaaaatttgactaaggaaagaagaccaacatgggctttccaaagttgagtttgaattctgccatccccactaagcagtcatgtgaccttggaaaaactccctactctgagtctcagtttctttatctgtattaggtttcaacaaagggaataaatcattggcttctcatgaggttgtcataaggattaaataagacaatgcatataaaagaactggcagacaataaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtgtcttgtcataaagatgggacgtgacttctttctgctcttgcttccatctggtgctgttttctgcacagcctccttgagaccttccagaaccttcttttttcctacttcatatcacttaaccagtagctatctgggatggttccagaggctgaagtttgcagttgaataacattttaaatagtgttaagcgacttgggatctctggccctttgcgtttcagtatttgtcctttttatgcctgatgtttaacctgccacatgtttgtactgcaacatgaatcttggaaattttaatgttatgcatttcaaatgtttttggttatctgtaaactaaatgtgcccttattggctcacttgtcaataaagatgtttgtatatgtattgtcagaaa

SEQ ID NO: 202039 - DNA, 5541 bp, Homo sapiens
  Payload ID: 19857
  Gene Name: zinc finger protein 286A
  Uniprot ID: Q9HBT8
  ENST ID: ENST00000421016
  CDS Start-End: 484-2049
cttcgatcgtccgattctcccagccgcaccacgggtgctcccacctgcggagaaccggagtctggcgatgccaaggcgcttctgggaattgtagttccgggcgggatgagggcagcacgcctggctccgctccttcttacgcatgcgcgactccgagctggccaaagaagttcgtcccctttgtgaggcccgggatgggaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaatgtaagttggttttatcactgtattaaatacttgagtgtttaggtggaaggcgcatccataatatgcatgtgaggaccaattctgtatgcatctaatttcatttgcgtaatacatagttttgagccataagcaggttctttatgtccgttaatttgataattatgaaatctagccagcgatttcaaaattttaatctccaacgtcccaaatagctatctgtggaaattcaagaagtccctgagagtaggtagcagtacgaacattgtgaaatccagttttcccctctcttgtttatgtcagagctttgttgtaagcctctcactttgtaaggaaattcttattgggtaggttaggctgagggcttacatccttatcatcaggaagacacaatgttgttatttattactccttgagatctagatacacatatggtataattcatctagagtgtaatttcttttatattagccttaaaaaccaaaaatgctgggttcaaagtccttagaattcccttcctccctcaacaagctgctgtctatgttgatgaccataactgggatgtataatatttacagacaactctaagttacgttcacatggattatgtacatcattgatttttttttttttttttttttgagacagagtcttgctctgttgcccgggctggagtgcagtggcgcgatctcggctcactgcaacctccacctcccaggttcatgccattctcttgtctcagcctcccaagtagctgggactacaggcacctgccagtacgcctggctaattttttttgtatttttagtagagatggggtttcaccatgttagccaggatggtcttgatctcctgacctcgtgatctgcctgcctcggcctcccaaagtgctgggattacaggcatgagccaccatgcctggcatcatcattgatttatgtcattgttatccctctaccgcggagaccttctttcattttccatttccctgggagttcacgtgaagtagtgaatgggtcaaaatcttaacagtggttgttgatcaagtccttcctttcttatccttggcactgaataaatctttggttttccataatcaaagggtgagggagacttcttttgtctacattattcagctttctgaaagctatgctgtgtccatttgagaaaaagccccagggatattgaaggtctgagaagttgagtggttcagtgtgttattatatttagggtcccagtaaagaagaactgaagcaactgtgagacaccagggcatacttccctgtatgagtggaaaacaaggcacggaaaatagctcacaggatagtcctcaactgacttgcttgaggataagcagcttcccttcgtgaagaagttgccatttctctggccttcatatttatctactttttgttattgttgtctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgcgtggtccagtcaccttgcaccaggccccacctcccacattggggattacaattaaacatgagatttgggtggggatacagatctaaactgtatcattactcaaaaaaaaaaaaaaaaagaaagaaaagaaaacacaggaaaaggaactcacctcttttatcatcttagtatttagtactaatggtttagagcaggaattgacaaactgtggcctggactcatggaccaactctggcccaccacctgtttctcagaagaaaattttattggaactcagccacacttactcatttacatgttgtccttgactgcctttgtgtccagtgtcagaactgagtagctgcagcggaggttgtgcctctgggctttaatatcacaaacagagcagcttataagcaacagaaacttacttctcacagttttggaggctgggaagtccaagatcaaggtgtcaacatatttagggtctagggaaggtctgcttcttggttaatagaaagcacctttcactgtgtcttcacatggtagaaggggagagctctggtatcttcagccccttataagggcactaatcccattcatgagagctccaccctcacgacctaatcacctccaaaaggccccatttcgtaataccgtcagttaagtttcattatatgactttgatggggatatagcccatagtaggttgtatgtccctgaaagcctaaaatatttactgtttggctctttacagaaaatattttcttggcccctgttccagagcattcatcaagtcagataaagggtttaaaccagtcagagaaactaggtggaatggaaaagtactgagagataattggggacagaaaaataaaagagatgggaaatgctgcatcaaaatactcctacctctaggatgttactatatattgttaggagaattcaagttattgaaacttgccaaattcttgagtgaagaggaattcatttgagagccaaaatttgactaaggaaagaagaccaacatgggctttccaaagttgagtttgaattctgccatccccactaagcagtcatgtgaccttggaaaaactccctactctgagtctcagtttctttatctgtattaggtttcaacaaagggaataaatcattggcttctcatgaggttgtcataaggattaaataagacaatgcatataaaagaactggcagacaataaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtgtcttgtcataaagatgggacgtgacttctttctgctcttgcttccatctggtgctgttttctgcacagcctccttgagaccttccagaaccttcttttttcctacttcatatcacttaaccagtagctatctgggatggttccagaggctgaagtttgcagttgaataacattttaaatagtgttaagcgacttgggatctctggccctttgcgtttcagtatttgtcctttttatgcctgatgtttaacctgccacatgtttgtactgcaacatgaatcttggaaattttaatgttatgcatttcaaatgtttttggttatctgtaaactaaatgtgcccttattggctcacttgtcaataaagatgtttgtatatgtattgtc

SEQ ID NO: 202040 - DNA, 402 bp, Homo sapiens
  Payload ID: 19857
  Gene Name: zinc finger protein 286A
  ENST ID: ENST00000583031
  CDS Start-End: 221-402
ccctttgtgaggcccgggatgggaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccagaactgcctttttgttgagcacagaaaacgaaggaaatttgcatttccaatgtcttt

SEQ ID NO: 202041 - DNA, 827 bp, Homo sapiens
  Payload ID: 19857
  Gene Name: zinc finger protein 286A
  ENST ID: ENST00000472486
  CDS Start-End: 33-353
caaagaagttcgtcccctttgtgaggcccgggatgggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagaactgcctttttgttgagcacagaaaacgaaggaaatttgcatttccaatgtctttcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccatt

SEQ ID NO: 202042 - DNA, 527 bp, Homo sapiens
  Payload ID: 19857
  Gene Name: zinc finger protein 286A
  ENST ID: ENST00000580259
  CDS Start-End: 255-437
atgcgcgactccgagctggccaaagaagttcgtcccctttgtgaggcccgggatgggaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccagggcttccagtttccaaacctgagagctacaacttggagaatggaaaagaaccattgaagcttgagagaaaagcccccaaaagcagctattcagacatggagactagaccacagagcaaggattcaacttcagtgcaagatttttcca

SEQ ID NO: 202043 - DNA, 541 bp, Homo sapiens
  Payload ID: 19857
  Gene Name: zinc finger protein 286A
  ENST ID: ENST00000580393
  CDS Start-End: 28-541
aagttcgtcccctttgtgaggcccgggatgggagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagattttt

SEQ ID NO: 202044 - DNA, 607 bp, Homo sapiens
  Payload ID: 19857
  Gene Name: zinc finger protein 286A
  ENST ID: ENST00000585194
  CDS Start-End: 229-579
agttcgtcccctttgtgaggcccgggatgggaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagaactgcctttttgttgagcacagaaaacgaaggaaatttgcattt

SEQ ID NO: 202045 - DNA, 560 bp, Homo sapiens
  Payload ID: 19857
  Gene Name: zinc finger protein 286A
  ENST ID: ENST00000581529
  CDS Start-End: 32-184
aaagaagttcgtcccctttgtgaggcccgggatgggagctctgtcttcccaggattctccccatttccaagagaagagcacagaagagggagaagtggctgctctgcgcctcacggccagatcccagggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaa

SEQ ID NO: 202046 - DNA, 1806 bp, Homo sapiens
  Payload ID: 19857
  Gene Name: zinc finger protein 286A
  Uniprot ID: Q9HBT8
  ENST ID: ENST00000583566
  CDS Start-End: 241-1806
gctggccaaagaagttcgtcccctttgtgaggcccgggatgggaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctga

SEQ ID NO: 202047 - DNA, 5616 bp, Homo sapiens
  Payload ID: 19857
  Gene Name: zinc finger protein 286A
  Uniprot ID: Q9HBT8
  ENST ID: ENST00000464847
  CDS Start-End: 554-2119
ggtgagttgcttgtggtgatgtcgctcgtctcggctcggcctcggcggtggttccccgggtcgttctgtgccgagtcggggctagagtgcgcgtttgttaaaggggcctcgagggcagaccatgagccctgtcccttctcactctggcctgatcctctcctcgggggacgcggttgtgccacgggcggggtggtcgcggggttctgggccagtgccccgagcgcggcagaatttgtccaaactcctgatgccccagcgtcacctcttccaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaatgtaagttggttttatcactgtattaaatacttgagtgtttaggtggaaggcgcatccataatatgcatgtgaggaccaattctgtatgcatctaatttcatttgcgtaatacatagttttgagccataagcaggttctttatgtccgttaatttgataattatgaaatctagccagcgatttcaaaattttaatctccaacgtcccaaatagctatctgtggaaattcaagaagtccctgagagtaggtagcagtacgaacattgtgaaatccagttttcccctctcttgtttatgtcagagctttgttgtaagcctctcactttgtaaggaaattcttattgggtaggttaggctgagggcttacatccttatcatcaggaagacacaatgttgttatttattactccttgagatctagatacacatatggtataattcatctagagtgtaatttcttttatattagccttaaaaaccaaaaatgctgggttcaaagtccttagaattcccttcctccctcaacaagctgctgtctatgttgatgaccataactgggatgtataatatttacagacaactctaagttacgttcacatggattatgtacatcattgatttttttttttttttttttttgagacagagtcttgctctgttgcccgggctggagtgcagtggcgcgatctcggctcactgcaacctccacctcccaggttcatgccattctcttgtctcagcctcccaagtagctgggactacaggcacctgccagtacgcctggctaattttttttgtatttttagtagagatggggtttcaccatgttagccaggatggtcttgatctcctgacctcgtgatctgcctgcctcggcctcccaaagtgctgggattacaggcatgagccaccatgcctggcatcatcattgatttatgtcattgttatccctctaccgcggagaccttctttcattttccatttccctgggagttcacgtgaagtagtgaatgggtcaaaatcttaacagtggttgttgatcaagtccttcctttcttatccttggcactgaataaatctttggttttccataatcaaagggtgagggagacttcttttgtctacattattcagctttctgaaagctatgctgtgtccatttgagaaaaagccccagggatattgaaggtctgagaagttgagtggttcagtgtgttattatatttagggtcccagtaaagaagaactgaagcaactgtgagacaccagggcatacttccctgtatgagtggaaaacaaggcacggaaaatagctcacaggatagtcctcaactgacttgcttgaggataagcagcttcccttcgtgaagaagttgccatttctctggccttcatatttatctactttttgttattgttgtctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgcgtggtccagtcaccttgcaccaggccccacctcccacattggggattacaattaaacatgagatttgggtggggatacagatctaaactgtatcattactcaaaaaaaaaaaaaaaaagaaagaaaagaaaacacaggaaaaggaactcacctcttttatcatcttagtatttagtactaatggtttagagcaggaattgacaaactgtggcctggactcatggaccaactctggcccaccacctgtttctcagaagaaaattttattggaactcagccacacttactcatttacatgttgtccttgactgcctttgtgtccagtgtcagaactgagtagctgcagcggaggttgtgcctctgggctttaatatcacaaacagagcagcttataagcaacagaaacttacttctcacagttttggaggctgggaagtccaagatcaaggtgtcaacatatttagggtctagggaaggtctgcttcttggttaatagaaagcacctttcactgtgtcttcacatggtagaaggggagagctctggtatcttcagccccttataagggcactaatcccattcatgagagctccaccctcacgacctaatcacctccaaaaggccccatttcgtaataccgtcagttaagtttcattatatgactttgatggggatatagcccatagtaggttgtatgtccctgaaagcctaaaatatttactgtttggctctttacagaaaatattttcttggcccctgttccagagcattcatcaagtcagataaagggtttaaaccagtcagagaaactaggtggaatggaaaagtactgagagataattggggacagaaaaataaaagagatgggaaatgctgcatcaaaatactcctacctctaggatgttactatatattgttaggagaattcaagttattgaaacttgccaaattcttgagtgaagaggaattcatttgagagccaaaatttgactaaggaaagaagaccaacatgggctttccaaagttgagtttgaattctgccatccccactaagcagtcatgtgaccttggaaaaactccctactctgagtctcagtttctttatctgtattaggtttcaacaaagggaataaatcattggcttctcatgaggttgtcataaggattaaataagacaatgcatataaaagaactggcagacaataaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtgtcttgtcataaagatgggacgtgacttctttctgctcttgcttccatctggtgctgttttctgcacagcctccttgagaccttccagaaccttcttttttcctacttcatatcacttaaccagtagctatctgggatggttccagaggctgaagtttgcagttgaataacattttaaatagtgttaagcgacttgggatctctggccctttgcgtttcagtatttgtcctttttatgcctgatgtttaacctgccacatgtttgtactgcaacatgaatcttggaaattttaatgttatgcatttcaaatgtttttggttatctgtaaactaaatgtgcccttattggctcacttgtcaataaagatgtttgtatatgtattgtcagaaa

SEQ ID NO: 202048 - DNA, 5222 bp, Homo sapiens
  Payload ID: 19857
  Gene Name: zinc finger protein 286A
  Uniprot ID: Q9HBT8
  ENST ID: ENST00000593105
  CDS Start-End: 195-1730
cttcgatcgtccgattctcccagccgcaccacgggtgctcccacctgcggagaaccggagtctggcgatgccaaggcgcttctgggaattgtagttccgggcgggatgagggcagcacgcctggctccgctccttcttacgcatgcgcgactccgagctggccaaagaagttcgtcccctttgtgaggcccgggatgggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaatgtaagttggttttatcactgtattaaatacttgagtgtttaggtggaaggcgcatccataatatgcatgtgaggaccaattctgtatgcatctaatttcatttgcgtaatacatagttttgagccataagcaggttctttatgtccgttaatttgataattatgaaatctagccagcgatttcaaaattttaatctccaacgtcccaaatagctatctgtggaaattcaagaagtccctgagagtaggtagcagtacgaacattgtgaaatccagttttcccctctcttgtttatgtcagagctttgttgtaagcctctcactttgtaaggaaattcttattgggtaggttaggctgagggcttacatccttatcatcaggaagacacaatgttgttatttattactccttgagatctagatacacatatggtataattcatctagagtgtaatttcttttatattagccttaaaaaccaaaaatgctgggttcaaagtccttagaattcccttcctccctcaacaagctgctgtctatgttgatgaccataactgggatgtataatatttacagacaactctaagttacgttcacatggattatgtacatcattgatttttttttttttttttttttgagacagagtcttgctctgttgcccgggctggagtgcagtggcgcgatctcggctcactgcaacctccacctcccaggttcatgccattctcttgtctcagcctcccaagtagctgggactacaggcacctgccagtacgcctggctaattttttttgtatttttagtagagatggggtttcaccatgttagccaggatggtcttgatctcctgacctcgtgatctgcctgcctcggcctcccaaagtgctgggattacaggcatgagccaccatgcctggcatcatcattgatttatgtcattgttatccctctaccgcggagaccttctttcattttccatttccctgggagttcacgtgaagtagtgaatgggtcaaaatcttaacagtggttgttgatcaagtccttcctttcttatccttggcactgaataaatctttggttttccataatcaaagggtgagggagacttcttttgtctacattattcagctttctgaaagctatgctgtgtccatttgagaaaaagccccagggatattgaaggtctgagaagttgagtggttcagtgtgttattatatttagggtcccagtaaagaagaactgaagcaactgtgagacaccagggcatacttccctgtatgagtggaaaacaaggcacggaaaatagctcacaggatagtcctcaactgacttgcttgaggataagcagcttcccttcgtgaagaagttgccatttctctggccttcatatttatctactttttgttattgttgtctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgcgtggtccagtcaccttgcaccaggccccacctcccacattggggattacaattaaacatgagatttgggtggggatacagatctaaactgtatcattactcaaaaaaaaaaaaaaaaagaaagaaaagaaaacacaggaaaaggaactcacctcttttatcatcttagtatttagtactaatggtttagagcaggaattgacaaactgtggcctggactcatggaccaactctggcccaccacctgtttctcagaagaaaattttattggaactcagccacacttactcatttacatgttgtccttgactgcctttgtgtccagtgtcagaactgagtagctgcagcggaggttgtgcctctgggctttaatatcacaaacagagcagcttataagcaacagaaacttacttctcacagttttggaggctgggaagtccaagatcaaggtgtcaacatatttagggtctagggaaggtctgcttcttggttaatagaaagcacctttcactgtgtcttcacatggtagaaggggagagctctggtatcttcagccccttataagggcactaatcccattcatgagagctccaccctcacgacctaatcacctccaaaaggccccatttcgtaataccgtcagttaagtttcattatatgactttgatggggatatagcccatagtaggttgtatgtccctgaaagcctaaaatatttactgtttggctctttacagaaaatattttcttggcccctgttccagagcattcatcaagtcagataaagggtttaaaccagtcagagaaactaggtggaatggaaaagtactgagagataattggggacagaaaaataaaagagatgggaaatgctgcatcaaaatactcctacctctaggatgttactatatattgttaggagaattcaagttattgaaacttgccaaattcttgagtgaagaggaattcatttgagagccaaaatttgactaaggaaagaagaccaacatgggctttccaaagttgagtttgaattctgccatccccactaagcagtcatgtgaccttggaaaaactccctactctgagtctcagtttctttatctgtattaggtttcaacaaagggaataaatcattggcttctcatgaggttgtcataaggattaaataagacaatgcatataaaagaactggcagacaataaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtgtcttgtcataaagatgggacgtgacttctttctgctcttgcttccatctggtgctgttttctgcacagcctccttgagaccttccagaaccttcttttttcctacttcatatcacttaaccagtagctatctgggatggttccagaggctgaagtttgcagttgaataacattttaaatagtgttaagcgacttgggatctctggccctttgcgtttcagtatttgtcctttttatgcctgatgtttaacctgccacatgtttgtactgcaacatgaatcttggaaattttaatgttatgcatttcaaatgtttttggttatctgtaaactaaatgtgcccttattggctcacttgtcaataaagatgtttgtatatgtattgtc

SEQ ID NO: 202049 - DNA, 427 bp, Homo sapiens
  Payload ID: 19857
  Gene Name: zinc finger protein 286A
  ENST ID: ENST00000481540
  CDS Start-End: 1-279
gagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcaggtgagccagatagatgggagtcttcataaatgatagcccagcaggacaatgaagaaatacttttcagtgcttaagaaagtgcctgtgtgcccttatttttaaatttttttaaaattctaaagcatttaaaatatatacagaagtccagaaaataaaataacattcatgtatccatca

SEQ ID NO: 202050 - DNA, 574 bp, Homo sapiens
  Payload ID: 19857
  Gene Name: zinc finger protein 286A
  ENST ID: ENST00000579694
  CDS Start-End: 218-574
aaagaagttcgtcccctttgtgaggcccgggatgggagaactataggaacctagtctcactttggcttccagtttccaaacctgagagctacaacttggagaatggaaaagaaccattgaagcttgagagaaaagcccccaaaagcagctattcagaactgcctttttgttgagcacagaaaacgaaggaaatttgcatttccaatgtctttcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatg

SEQ ID NO: 202051 - DNA, 5145 bp, Homo sapiens
  Payload ID: 19858
  Gene Name: zinc finger protein 286B
  ENST ID: ENST00000285274
  CDS Start-End: 221-418
ccctttgtgaggcccgggatgggaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagttctgtcttcccaggattctccccatttccaagagaagagcacagaagagggagaagtggctgctctgcgcctcacggccagatcccagaactgcctttttgttgagcacagaaaacgaaggaaatttgcatttccaatgtccttcagacgtggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaagcagcaaggaaatcaggagagacatttgagagaaatgttcactcacatgaattcactctctgaggaaacagaccatgagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctgccattcagtgcatattcaacaccagagagtccatactggagagaaaccctatacctgcaatgaatgtgggaaatcttttagccacagagctaatttaactaaacaccagagaactcatactagaattctctttgaatgccgtgaatgtaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaggccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtagtgaatgtgggaaaaccttcagccagagctccaattttgctaaacatcaaagaattcatattggaaagaaaccgtacaaatgtagtgagtgtggaaaagccttcattcattcatcagctcttattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaatgtaagttggttttatcactatattaaatacttgagtgtttaggtggaaggcccatccataatatgcatgtgaggaccaattctatatgcatctaatttcatttgtgtaatacatagttttgagccataggcaggttctttatgtccgttaatttgataattatgaaatctagccagcgatttcaaaattttaatctccaacctcccaaatagctatctgtggaaattcaagaagtccctgagagtgggtagcagtacaaacattgtgaaatccagttttcccctctcttgtttatgtcagagctttgttgtaagcctctcactttgtaaggaaattcttattgggtaggttaggctgagggcttacatccttatcatcaggaagacacaatgttgttatttattactccttgagatctagatacacatatggtataattcatctagagtgtcatttcttttatattagccttaaaaaccaaaaatgctgggttcaaagtccttagcattcccttcctccctcaacaagctgctgtctattttgatgaccataactaggatgtataatatttacagacaattctaatttatgttcacatggattatgtacatcattgatttttttttttttttttttttgagacagagtctcgctctgttgcccgggctggagtgcagtggcgtgatctcagctcactgcaacctccacctcccaggttcatgccattctcttgtctcagcctcctgagtagctgggactacaggcacctgccagtacgcctggctaattttttttgtatttttagtagagatggggtttcaccatgttagccaggatggtcttgatctcctgacctcgtgatctgcctgcctcggcctcccaaagtgctgggattacaggcgtgagccaccatgcctggcatcatcattgatttatgtcattgttatccctctaccgcggagaccttctttcattttccatttccctgggagttcacgtgaagtagtgaatgggtcaaaatcttaacagtggttgttgatcaagtccttcctttcttatccttggcactgaataaatctttggttttccataatcaaagggtgagggagacttcttttgtctacattattcagctttctgaaagctatgctgtgtccatttgagaaaaagccccagggatattgaaggtctgagaagttgagtggttcagtgtgttattatatttagggtcccagtaaagaagaactgaagcaactgtgagacaccagggcatacttccctgtatgagtggaaaacaaggtacggaaaatagctcacaggatagtcctcaactgacttgcttgaggataagcagcttcccttcatgaagaagttgccatttctctggccttcatatttacctactttttgttattgttatctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgcgtggtccagtcaccttgcaccaggccccacctcccacattggggattacaattaaacatgagatttgggtggggatacagatctaaactgtatcattactcaaaaaaaaaaaaaaaagaaaaaagaaagaaaacacaggaaaaggaactcacctcttttatcatcttagtatttagtactaatggtttagagcaggagttgacaaactgtggcctggactcatggaccaactctggcccaccacctgtttctcagaagaaaattttattggaactcagccacacttactcatttacatgttgtccttgactgcctttgtgtccagtgtcagaactgagtagctgcagcggaggttgtgcctctgggctttaatatcacaaacagagcagcttataagcaacagaaacttacttctcacagttttggaggctgggaagtccaagatcaaggtgtcaacatatttagggtctagggaaggtctgcttcttggttaatagaaagcacctttcactgtgtcttcacatggtagaaggggagagctctggtatcttcaggcccttataagggcactaatcccattcatgagcgctccaccctcacgacctaatcacctccaaaaggccccatttcataataccatcaattaagtttcattatatgactttgatggggatatagcccatagtaggttctatgtccctgaaagcctaaaatatttactgtttggctctttacagaaaatattttcttggcccctgttccagagcattcatcaagaagtcagataaagggtttaaaccagtcagagaaagtaggtggaatggaaaagttgaacttactgagagataactggggacagaaaaataaaagaggtgggaaatgatgcatcaaaatactcctacctctaggatgttactatatattgtcaggagaattcaagttattgaaacttgccaaattcttgagtgaaaagaaattcatttgagggccaaaatttgactaaggaaagaagaccaacatgggctttccaaagttgagtttgaattctgccatccccactaagcagtcatgtgaccttggaaaaactccctactctgagtctcagtttctttatctgtattaggtttcaacaaagggaataaatcattggcttctcatgaggttgtcataaggattaaataagacaatgcatacaaaagaactggcagacaataaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtggcttgtcataaagatgggacgtgacttctttctgctcttgcttccatctggtgctgttttctgcacagcctccttgagaccttccagaaccttcttttttcctacttcgtatcacttaaccagtagctatctgggatggttccagaggctgaagtttgcagttgaataacattttaaatagtgttaagcgacttgggatctctggccctttgcgtttcagtatttgtcctttttatgcctgatgtttaacctgccacatgtttgtactgcaacatgaatcttggaaattttaatgttatgcatttcaaatgtttttggttatctgtaaactaaatgtgcccttattggctcacttgtcaataaagatgtttgtatatgttttgtcagaaa

SEQ ID NO: 202052 - DNA, 504 bp, Homo sapiens
  Payload ID: 19858
  Gene Name: zinc finger protein 286B
  ENST ID: ENST00000443457
  CDS Start-End: 168-504
tccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggaggtgagaattgcggacgtgttgaacttgtagcgtggaaggacgaaattcctgctcctgaagggaaaacggttggctcaggggaggtggctcttggctggctgtctccattgtcttggggatggatgggctttttaagtgagactgaagagcttggtatgggagcaccgccctttccatggcagctgggcacacagtggacccttcaaagctacccccaaaatttctgtcttcccaggattctccccatttccaagagaagagcacagaagagggagaagtggctgctctgcgcctcacggc

SEQ ID NO: 202053 - DNA, 5328 bp, Homo sapiens
  Payload ID: 19858
  Gene Name: zinc finger protein 286B
  Uniprot ID: P0CG31
  ENST ID: ENST00000545289
  CDS Start-End: 252-1820
cgcgactccgagctggccaaagaagttcgtcccctttgtgaggcccgggatgggaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagttctgtcttcccaggattctccccatttccaagagaagagcacagaagagggagaagtggctgctctgcgcctcacggccagatcccaggcggcggcggcggcggcggcgcccgggagccggagccttcgcggcgtccacgtccctcccccgctgcaccccgccccggcgcgagaggagatcaaatccacttgctccttgaaggcatgcttttcactttcattaactcttacctattacagaactgcctttttgttgagcacagaaaacgaaggaaatttgcatttccaatgtccttcagacgtggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaagcagcaaggaaatcaggagagacatttgagagaaatgttcactcacatgaattcactctctgaggaaacagaccatgagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctgccattcagtgcatattcaacaccagagagtccatactggagagaaaccctatacctgcaatgaatgtgggaaatcttttagccacagagctaatttaactaaacaccagagaactcatactagaattctctttgaatgccgtgaatgtaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaggccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtagtgaatgtgggaaaaccttcagccagagctccaattttgctaaacatcaaagaattcatattggaaagaaaccgtacaaatgtagtgagtgtggaaaagccttcattcattcatcagctcttattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaatgtaagttggttttatcactatattaaatacttgagtgtttaggtggaaggcccatccataatatgcatgtgaggaccaattctatatgcatctaatttcatttgtgtaatacatagttttgagccataggcaggttctttatgtccgttaatttgataattatgaaatctagccagcgatttcaaaattttaatctccaacctcccaaatagctatctgtggaaattcaagaagtccctgagagtgggtagcagtacaaacattgtgaaatccagttttcccctctcttgtttatgtcagagctttgttgtaagcctctcactttgtaaggaaattcttattgggtaggttaggctgagggcttacatccttatcatcaggaagacacaatgttgttatttattactccttgagatctagatacacatatggtataattcatctagagtgtcatttcttttatattagccttaaaaaccaaaaatgctgggttcaaagtccttagcattcccttcctccctcaacaagctgctgtctattttgatgaccataactaggatgtataatatttacagacaattctaatttatgttcacatggattatgtacatcattgatttttttttttttttttttttgagacagagtctcgctctgttgcccgggctggagtgcagtggcgtgatctcagctcactgcaacctccacctcccaggttcatgccattctcttgtctcagcctcctgagtagctgggactacaggcacctgccagtacgcctggctaattttttttgtatttttagtagagatggggtttcaccatgttagccaggatggtcttgatctcctgacctcgtgatctgcctgcctcggcctcccaaagtgctgggattacaggcgtgagccaccatgcctggcatcatcattgatttatgtcattgttatccctctaccgcggagaccttctttcattttccatttccctgggagttcacgtgaagtagtgaatgggtcaaaatcttaacagtggttgttgatcaagtccttcctttcttatccttggcactgaataaatctttggttttccataatcaaagggtgagggagacttcttttgtctacattattcagctttctgaaagctatgctgtgtccatttgagaaaaagccccagggatattgaaggtctgagaagttgagtggttcagtgtgttattatatttagggtcccagtaaagaagaactgaagcaactgtgagacaccagggcatacttccctgtatgagtggaaaacaaggtacggaaaatagctcacaggatagtcctcaactgacttgcttgaggataagcagcttcccttcatgaagaagttgccatttctctggccttcatatttacctactttttgttattgttatctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgcgtggtccagtcaccttgcaccaggccccacctcccacattggggattacaattaaacatgagatttgggtggggatacagatctaaactgtatcattactcaaaaaaaaaaaaaaaagaaaaaagaaagaaaacacaggaaaaggaactcacctcttttatcatcttagtatttagtactaatggtttagagcaggagttgacaaactgtggcctggactcatggaccaactctggcccaccacctgtttctcagaagaaaattttattggaactcagccacacttactcatttacatgttgtccttgactgcctttgtgtccagtgtcagaactgagtagctgcagcggaggttgtgcctctgggctttaatatcacaaacagagcagcttataagcaacagaaacttacttctcacagttttggaggctgggaagtccaagatcaaggtgtcaacatatttagggtctagggaaggtctgcttcttggttaatagaaagcacctttcactgtgtcttcacatggtagaaggggagagctctggtatcttcaggcccttataagggcactaatcccattcatgagcgctccaccctcacgacctaatcacctccaaaaggccccatttcataataccatcaattaagtttcattatatgactttgatggggatatagcccatagtaggttctatgtccctgaaagcctaaaatatttactgtttggctctttacagaaaatattttcttggcccctgttccagagcattcatcaagaagtcagataaagggtttaaaccagtcagagaaagtaggtggaatggaaaagttgaacttactgagagataactggggacagaaaaataaaagaggtgggaaatgatgcatcaaaatactcctacctctaggatgttactatatattgtcaggagaattcaagttattgaaacttgccaaattcttgagtgaaaagaaattcatttgagggccaaaatttgactaaggaaagaagaccaacatgggctttccaaagttgagtttgaattctgccatccccactaagcagtcatgtgaccttggaaaaactccctactctgagtctcagtttctttatctgtattaggtttcaacaaagggaataaatcattggcttctcatgaggttgtcataaggattaaataagacaatgcatacaaaagaactggcagacaataaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtggcttgtcataaagatgggacgtgacttctttctgctcttgcttccatctggtgctgttttctgcacagcctccttgagaccttccagaaccttcttttttcctacttcgtatcacttaaccagtagctatctgggatggttccagaggctgaagtttgcagttgaataacattttaaatagtgttaagcgacttgggatctctggccctttgcgtttcagtatttgtcctttttatgcctgatgtttaacctgccacatgtttgtactgcaacatgaatcttggaaattttaatgttatgcatttcaaatgtttttggttatctgtaaactaaatgtgcccttattggctcacttgtcaataaagatgtttgtatatgttttgtcagaaa

SEQ ID NO: 202054 - DNA, 640 bp, Homo sapiens
  Payload ID: 19858
  Gene Name: zinc finger protein 286B
  ENST ID: ENST00000580145
  CDS Start-End: 252-640
cgcgactccgagctggccaaagaagttcgtcccctttgtgaggcccgggatgggaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagttctgtcttcccaggattctccccatttccaagagaagagcacagaagagggagaagtggctgctctgcgcctcacggccagatcccaggcggcggcggcggcggcggcgcccgggagccggagccttcgcggcgtccacgtccctcccccgctgcaccccgccccggcgcgagaggagagcgcgagaaccccagccgcggccgggcgggcggcgaagatggcagaggcaccggcttccccggccccgctttctccgctcgaagtggagctggacccggagttcgagccccagagccgtccgcgatcctgtacgtggcccctgcaaaggccggagctccaagcgagccctgc

SEQ ID NO: 202055 - DNA, 525 bp, Homo sapiens
  Payload ID: 19858
  Gene Name: zinc finger protein 286B
  ENST ID: ENST00000583002
  CDS Start-End: 208-525
ccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagttctgtcttcccaggattctccccatttccaagagaagagcacagaagagggagaagtggctgctctgcgcctcacggccagatcccaggcggcggcggcggcggcggcgcccgggagccggagccttcgcggcgtccacgtccctcccccgctgcaccccgccccggcgcgagaggagagcgcgagaaccccagccgcggccgggcgggcggcgaagatggcagaggcaccggcttccccggccccgctttctccgctcgaagtggagctggacccggag

SEQ ID NO: 202056 - DNA, 3373 bp, Homo sapiens
  Payload ID: 19859
  Gene Name: zinc finger protein 287
  Uniprot ID: Q9HBT7
  ENST ID: ENST00000395824
  CDS Start-End: 619-2904
cgccggggtttctgggccgggcttctcaggaccgggctggaacgtgcagctcctggccgggacactctgtgctttgcggggaagggaagtggcggagcccgaggatccgctgccgctcgggactgagcccgccacgcaggcgcctgtgccagcgtcgccattgttgcctgtggccttagggccgctccggctgcccgtcggccgggtcccagcgacaggtattgatgtccgggcgcagcgcgcgagtgtccgcgcgatcagtgacagcccgagcccgtccacgcgcgggctcccgtgctcgtggcttgcgggagggcaaagacggggtggaggctgctgtgggcccagtcccagcgttgcgcgtcgcacggtccccgactcccccgctgccctcgacctcgaccctgcggctgaagaggaggtctcttatccatccctgcaagttctgggctcagaatttgtcactaaggctgctaactctaccttgattctgttctgccctcggctgcagcagcctttgatatagtgtccttgtgactctagcatgagacttcaagcagttggctcactactggagaaataaaggatattgccagattgactctcctgtctgtagcaatgttagcctcaagcaagaggatgaacagttcttcacgttctcaaatccttctaaggtggaagtcagacaaggctcagagtggaccctacaatgttgagaaggaaatccttacttcaagattcttgcgtgacactgagacctgtcgacagaattttaggaattttccatacccagacctggctggtcctcgaaaggcattgagtcaactccgagagctctgccttaagtggctgagacctgagattcactcaaaggaacaaattttggagctgctggtgctggagcaattcctgaccatcctgcctggtgaggttaggacttgggtaaagtcccagtatccagagagcagcgaggaagcagtgactctggtggaggatttgactcagattctagaagaggaagctcctcaaaactctaccctttcccaagataccccagaggaagaccccagaggaaaacatgctttccagacaggatggctaaatgacttggtgaccaaagaatcgatgacattcaaagatgtggctgtagacatcacccaggaggactgggagttaatgcgtcctgtgcagaaggaattatacaagactgtgacgttacagaactattggaacatggtttctctgggacttacagtgtacagaccaactgtgattcccatattggaagaaccatggatggtgataaaagaaattttagaaggccctagtccagaatgggaaactaaagcccaagcatgtactccagtggaggatatgtctaaactcacaaaggaagaaacccataccatcaaattagaagactcatatgactacgatgatagactagagaggcgaggaaaaggtggcttctggaaaattcacactgatgaaagaggtttcagtttgaagtcagtcctttcacaagaatatgatcctacagaagaatgtcttagtaaatatgatatatatagaaataattttgaaaagcattcaaacctaattgtacagtttgatacccaattagataataaaacttctgtgtataatgaaggcagggcaaccttcaatcatgtctcatatggtattgtacataggaaaatacttcctggagagaagccttacaagtgtaatgtgtgtgggaaaaaatttaggaaatacccatccctcctgaaacaccaaagtacccatgccaaagagaaatcgtatgaatgtgaagaatgtgggaaagagtttaggcatatctcatcccttattgcacatcagagaatgcacactggagaaaaaccatatgaatgccaccagtgtggtaaagccttcagccagcgtgcacaccttactatacatcagagaattcatactggagagaaaccctataagtgtgatgactgtgggaaagacttcagtcagcgtgcacaccttaccatccatcaaaggacacatactggagagaaaccatataaatgcttggaatgtggtaaaaccttcagtcatagttcatcactgattaatcatcagagagttcatactggagaaaaaccttatatatgcaatgaatgtgggaagactttcagtcagagtacacaccttcttcagcatcaaaaaatacatactgggaagaaaccatataaatgcaatgaatgttggaaagtgtttagtcagagtacttaccttattcgacatcagagaattcattctggagagaagtgttataaatgtaatgaatgtggaaaagcctttgctcattcctcaacccttattcaacatcaaaccactcacactggagagaaatcctatatatgtaatatatgtgggaaagccttcagccagagtgcaaatcttactcaacatcatagaacacatactggagagaaaccatataaatgcagtgtgtgtgggaaagcattcagccagagtgtgcaccttactcaacatcagaggattcataatggagaaaaaccctttaaatgcaatatatgtgggaaagcatatagacaaggcgcaaatcttactcagcatcaaaggattcatactggagaaaaaccctataaatgtaatgaatgtgggaaagctttcatttattcctcatcacttaatcaacatcagagaactcatactggagagagaccctataaatgtaatgaatgtgataaggattttagccagagaacatgccttattcaacaccagagaattcacacaggagagaaaccctatgcatgtcgtatatgtggtaaaaccttcacccagagtacaaaccttattcagcatcaacgtgttcatacaggtgccaaacatcgtaattaatggataagggaaacttcaattcggttttacaactttgtttcaattttgttttgtgcattctatgtgtcagaacattcagaagaagtctgaagaagtgcaatatgttagatactcagcagaagtatcagaagtagtggtatggatataacctatttagatttaatgtgaaatttaagaaggaaacttgacttcttaaccttaatttgatatgattttaattcattacagaaagaaaccctgtgaagggtattcaaaaacataactcatcaactctctatttcaagtacacttatcctttggtatactcgggggattggttccaggaccacccatgtatacgaaaatctacccatactcaagttgcacggtcagcctggtggaacctgtgtatatgaaaagccctacatctatgcaggtttcccatccctgaataatgtgctttcaaactctgttcagttgaaaaaaaaaa

SEQ ID NO: 202057 - DNA, 3208 bp, Homo sapiens
  Payload ID: 19859
  Gene Name: zinc finger protein 287
  Uniprot ID: Q9HBT7
  ENST ID: ENST00000395825
  CDS Start-End: 454-2739
gcagtgacgccgaggcgaggtcgcggctaagcagaggcgccggggtttctgggccgggcttctcaggaccgggctggaacgtgcagctcctggccgggacactctgtgctttgcggggaagggaagtggcggagcccgaggatccgctgccgctcgggactgagcccgccacgcaggcgcctgtgccagcgtcgccattgttgcctgtggccttagggccgctccggctgcccgtcggccgggtcccagcgacagggtctcttatccatccctgcaagttctgggctcagaatttgtcactaaggctgctaactctaccttgattctgttctgccctcggctgcagcagcctttgatatagtgtccttgtgactctagcatgagacttcaagcagttggctcactactggagaaataaaggatattgccagattgactctcctgtctgtagcaatgttagcctcaagcaagaggatgaacagttcttcacgttctcaaatccttctaaggtggaagtcagacaaggctcagagtggaccctacaatgttgagaaggaaatccttacttcaagattcttgcgtgacactgagacctgtcgacagaattttaggaattttccatacccagacctggctggtcctcgaaaggcattgagtcaactccgagagctctgccttaagtggctgagacctgagattcactcaaaggaacaaattttggagctgctggtgctggagcaattcctgaccatcctgcctggtgaggttaggacttgggtaaagtcccagtatccagagagcagcgaggaagcagtgactctggtggaggatttgactcagattctagaagaggaagctcctcaaaactctaccctttcccaagataccccagaggaagaccccagaggaaaacatgctttccagacaggatggctaaatgacttggtgaccaaagaatcgatgacattcaaagatgtggctgtagacatcacccaggaggactgggagttaatgcgtcctgtgcagaaggaattatacaagactgtgacgttacagaactattggaacatggtttctctgggacttacagtgtacagaccaactgtgattcccatattggaagaaccatggatggtgataaaagaaattttagaaggccctagtccagaatgggaaactaaagcccaagcatgtactccagtggaggatatgtctaaactcacaaaggaagaaacccataccatcaaattagaagactcatatgactacgatgatagactagagaggcgaggaaaaggtggcttctggaaaattcacactgatgaaagaggtttcagtttgaagtcagtcctttcacaagaatatgatcctacagaagaatgtcttagtaaatatgatatatatagaaataattttgaaaagcattcaaacctaattgtacagtttgatacccaattagataataaaacttctgtgtataatgaaggcagggcaaccttcaatcatgtctcatatggtattgtacataggaaaatacttcctggagagaagccttacaagtgtaatgtgtgtgggaaaaaatttaggaaatacccatccctcctgaaacaccaaagtacccatgccaaagagaaatcgtatgaatgtgaagaatgtgggaaagagtttaggcatatctcatcccttattgcacatcagagaatgcacactggagaaaaaccatatgaatgccaccagtgtggtaaagccttcagccagcgtgcacaccttactatacatcagagaattcatactggagagaaaccctataagtgtgatgactgtgggaaagacttcagtcagcgtgcacaccttaccatccatcaaaggacacatactggagagaaaccatataaatgcttggaatgtggtaaaaccttcagtcatagttcatcactgattaatcatcagagagttcatactggagaaaaaccttatatatgcaatgaatgtgggaagactttcagtcagagtacacaccttcttcagcatcaaaaaatacatactgggaagaaaccatataaatgcaatgaatgttggaaagtgtttagtcagagtacttaccttattcgacatcagagaattcattctggagagaagtgttataaatgtaatgaatgtggaaaagcctttgctcattcctcaacccttattcaacatcaaaccactcacactggagagaaatcctatatatgtaatatatgtgggaaagccttcagccagagtgcaaatcttactcaacatcatagaacacatactggagagaaaccatataaatgcagtgtgtgtgggaaagcattcagccagagtgtgcaccttactcaacatcagaggattcataatggagaaaaaccctttaaatgcaatatatgtgggaaagcatatagacaaggcgcaaatcttactcagcatcaaaggattcatactggagaaaaaccctataaatgtaatgaatgtgggaaagctttcatttattcctcatcacttaatcaacatcagagaactcatactggagagagaccctataaatgtaatgaatgtgataaggattttagccagagaacatgccttattcaacaccagagaattcacacaggagagaaaccctatgcatgtcgtatatgtggtaaaaccttcacccagagtacaaaccttattcagcatcaacgtgttcatacaggtgccaaacatcgtaattaatggataagggaaacttcaattcggttttacaactttgtttcaattttgttttgtgcattctatgtgtcagaacattcagaagaagtctgaagaagtgcaatatgttagatactcagcagaagtatcagaagtagtggtatggatataacctatttagatttaatgtgaaatttaagaaggaaacttgacttcttaaccttaatttgatatgattttaattcattacagaaagaaaccctgtgaagggtattcaaaaacataactcatcaactctctatttcaagtacacttatcctttggtatactcgggggattggttccaggaccacccatgtatacgaaaatctacccatactcaagttgcacggtcagcctggtggaacctgtgtatatgaaaagccctacatctatgcaggtttcccatccctgaataatgtgctttcaaactctgttcagttgaaaaaaaaaa

SEQ ID NO: 202058 - DNA, 692 bp, Homo sapiens
  Payload ID: 19859
  Gene Name: zinc finger protein 287
  ENST ID: ENST00000448349
  CDS Start-End: 521-692
gccgaggcgaggtcgcggctaagcagaggcgccggggtttctgggccgggcttctcaggaccgggctggaacgtgcagctcctggccgggacactctgtgctttgcggggaagggaagtggcggagcccgaggatccgctgccgctcgggactgagcccgccacgcaggcgcctgtgccagcgtcgccattgttgcctgtggccttagggccgctccggctgcccgtcggccgggtcccagcgacagcagctccatcccccaccaaccccaagcagatggcagttcccttacaagtctaaggatataggggaggaagacaagggtctcttatccatccctgcaagttctgggctcagaatttgtcactaaggctgctaactctaccttgattctgttctgccctcggctgcagcagcctttgatatagtgtccttgtgactctagcatgagacttcaagcagttggctcactactggagaaataaaggatattgccagattgactctcctgtctgtagcaatgttagcctcaagcaagaggatgaacagttcttcacgttctcaaatccttctaaggtggaagtcagacaaggctcagagtggaccctacaatgttgagaaggaaatccttacttcaagattcttgcgtgacactgagacctgtcgacagaattttaggaattttccatacc

SEQ ID NO: 202059 - DNA, 8287 bp, Homo sapiens
  Payload ID: 19860
  Gene Name: zinc finger protein 292
  ENST ID: ENST00000339907
  CDS Start-End: 12-8168
ggggtgtgaagatggcggacgaagaggccgagcaggagaggttgagttgcggcgaaggcggctgcgtcgcggagctgcagcgcctgggcgagcggctccaggagctggagctacagctgcgggagagccgggtaccggccgtggaagcggccaccgactactgtcagcagctgtgccagacactcctagaatatgcagagaaatggaaaacttcagaagatcctttacctttattggaggtatacacagtggctatccaaagttatgttaaagcccgaccttatcttacctctgaatgtgaaaatgtagccttggttctggaacgcttggcattaagctgtgttgaacttttactgtgtctgcctgttgagttatcagataaacagtgggaacaatttcagacactggtgcaggtagctcatgaaaagctgatggagaatggcagctgtgaattgcattttttagctactctagctcaagagactggggtgtggaaaaacccggtactgtgcactattctttcccaggaaccattggataaggataaagcttttgagggtcccatcttgttggatatgagaattaaacatctaatcaaaacaaatcagttaagtcaagcaactgctctagcaaagctgtgttctgaccatccagagattggcataaaaggtagttttaagcaaacttaccttgtctgtctttgtacatcatcaccaaatggaaagttaatcgaagagatttcagaagttgattgcaaagatgcactggaaatgatctgtaacttagaatctgagggtgatgaaaaaagcgctcttgttttatgtactgcgtttttgtcacgtcagctccaacaaggagatatgtactgcgcttgggaacttactctcttttggagtaaattacaacaaagagtagaaccatctatacaagtgtaccttgagaggtgtcgtcaactttctttgttaacgaaaacagtatatcacattttcttcctgattaaagttattaattcagagactgaaggggctggacttgctacctgtatagaactgtgtgtaaaggctcttcgcttggagtctacagaaaatactgaagtgaaaatatctatttgcaagaccatttcatgtttgttgcctgatgatctggaagttaaacgtgcttgtcaactgagtgaatttcttattgagcctacagtagatgcgtattatgctgtggaaatgttgtataatcagccagaccagaaatatgatgaagagaatcttccaataccaaattctttacgctgtgagctgttacttgtattgaaaactcaatggccctttgatccagaattctgggattggaaaaccttgaaacgacaatgtcttgcattaatgggagaagaagcatccattgtgtcttcaatagatgaactaaatgacagtgaagtatatgaaaaagtggtagactaccaagaagagagtaaagaaacttctatgaatgggctttctggtggagttggtgctaattctggccttcttaaagacattggtgatgaaaagcagaagaagagagagataaaacagttaagagagaggggatttatatctgctcggtttaggaattggcaagcctacatgcagtattgtgtgttgtgtgacaaagaattccttggtcacagaatagtacgacatgctcagaaacattacaaagatggaatttatagttgccccatatgtgcaaagaactttaattctaaagaaacttttgtccctcatgtcacactgcatgttaaacaatctagtaaagagagactagcagctatgaaaccattaagaagattgggaaggcctccaaagatcacaactaccaatgaaaatcagaagactaatactgtggctaaacaggagcagcgacctataaaaaagaatagtctctattcaacagattttatagtgtttaatgacaatgatggttcagatgatgagaatgatgacaaagataaatcctatgagccagaagtgattccagtccagaaaccagtacctgttaatgaatttaattgccctgtaactttttgtaaaaagggctttaagtactttaaaaatttaattgctcatgtgaaggggcataaagataatgaagacgccaagcgctttcttgaaatgcagagcaaaaaagttatttgccagtactgtaggcggcattttgtgagtgttactcatctcaatgatcacttacagatgcactgtggcagtaaaccatatatctgtatacagatgaaatgtaaagctggttttaatagttacgccgagcttttaacccaccgaaaggagcatcaagtctttagagcaaaatgtatgtttcctaaatgtggaagaattttttcggaagcttatttactatatgatcatgaagcacaacattataatacgtacacttgtaagttcacaggttgtggtaaagtttatcgttctcagggtgagctggaaaagcatctggatgatcacagtactcctcctgaaaaagtgctgcctcctgaagcccaacttaattcatctggagattccattcagccttctgaagtgaatcagaacacagcagagaatattgagaaagaaagatctatgcttccttcagaaaataacattgaaaacagcttactagcagatagaagtgatgcttgggataaaagcaaagcagaatcagctgtgaccaaacaagaccagatttctgcctctgagctcaggcaagctaatggaccattgtcaaatggtttggaaaaccctgctactactcctctacttcaatccagtgaagtagctgtgtccattaaggtgtctctcaatcaggggattgaggataactttggaaagcaagaaaactcaactgtggaaggcagtggtgaagcactggtcacagacttacatacgccagttgaagatacttgtaatgatttgtgtcatccaggtttccaggagagaaaagaacaagattgctttaatgatgcccatgttactcagaattctttagtaaattcagaaactctcaaaataggtgaccttaccccacaaaacttagaaagacaagtgaacaacttgatgaccttttctgtgcaaaatcaggcagcatttcaaaacaatttaccaacttccaaatttgaatgtggagataatgttaaaacatcatccaatctttataatttacctcttaagacattagaaagtattgcatttgttccaccgcagtccgacctaagtaattcattaggaactccatcagtgcctccaaaagctccagttcagaaattcagctgccaggtcgagggatgtactcgaacctataattcttcacagagtattgggaaacacatgaagacagcacaccctgaccaatatgctgcatttaaaatgcagcgcaaaagtaaaaaaggtcagaaagctaacaacttaaatacaccaaataatggaaagtttgtttattttttgccatcaccggtgaacagctcaaatccattttttacatcacagaccaaagccaatgggaatcctgcttgttcggcccagttgcagcatgtctcgccacccatttttccagctcatttagcaagtgtgtcaactccattgttgtcctcaatggaaagtgtcataaatccaaatataacttctcaggataaaaatgaacaaggtggtatgttatgttcccaaatggaaaatttacctagtactgccttgccagcacaaatggaagatctaaccaaaacagttctgcctttgaatattgacagtggctcagatcctttccttcctttacctgcagaaagtagttcaatgtctctcttcccttcaccagcagatagtgggactaattctgttttttcccaactggaaaataatacaaatcattattcctcacagattgaaggaaacactaattcctcctttctaaaggggggtaatggtgaaaatgcagtttttccttcacaagtgaatgttgcaaataacttcagtagcaccaatgcccaacagtctgcacctgaaaaagttaaaaaagaccgtgggcggggcccaaatgggaaggaaagaaaacctaagcacaacaaaagggctaaatggcctgcaattatcagagatgggaaatttatctgtagcaggtgttacagggcttttactaatcccagatcactgggtgggcacttatccaagcgatcttactgtaaaccactggatggagccgaaattgctcaagaacttctacagagtaatggacagccttctcttcttgccagcatgattctctccacaaatgcagtaaatttgcagcagccacaacaatctaccttcaatccagaagcatgttttaaagatccatcatttctacagcttcttgctgaaaatcgctcgccagcatttttaccaaatacatttcctcgatctggtgtgactaactttaataccagtgtcagtcaagaaggtagtgaaattattaaacaggctttggaaactgctggcattcccagtacatttgagggtgccgaaatgctttctcatgtttcaacaggttgtgtctctgatgcatcacaagtaaatgcaacggtgatgccaaatccaactgtaccacccctgttgcacactgtatgccatccaaacaccttgctgaccaaccagaataggacgtcaaactccaaaacttcctccattgaggaatgtagcagcttgcctgtttttccaacgaatgacttactactgaagactgttgaaaatggtttgtgctctagttcatttcctaattctggtgggccatcacaaaattttaccagtaacagttctcgtgtttctgttataagtggtcctcagaacacaagatccagtcatttaaataaaaagggaaacagtgcttctaagagaagaaagaaagttgctcctccactaattgcacctaacgcttcccaaaacttggtaacaagtgacttaacaacaatgggactcatagcaaagagtgttgaaatcccaactactaaccttcattcaaatgtaattccaacttgtgaacctcagagtttggtggaaaatctaacacagaaattaaataatgttaacaatcagttatttatgactgatgtaaaagagaatttcaaaaccagtcttgagtcccatacagtgttagcccctttaacattaaaaactgaaaatggtgattcccaaatgatggctttgaattcatgcacaacttcaataaattctgatttgcagatttctgaagacaatgttatacaaaactttgaaaagactcttgaaattattaaaactgctatgaattctcaaatacttgaggtaaaaagtggatctcagggtgctggtgaaacttcacaaaatgctcaaataaattataacattcagcttccttcagtaaacactgtgcaaaataacaaattacccgattcttctccgttttcctcctttataagtgtcatgccaacaaaaagtaacattcctcagtctgaagtatcacataaggaggatcaaatacaggaaattttagaaggcttacagaaattaaaattagaaaatgacctatccactccagcatcccaatgtgtactgataaatacatcagtgacactgactcccacgcctgttaaatcaactgcagatatcacagttattcagccagtttctgaaatgataaacattcaatttaatgacaaagttaataaaccctttgtgtgtcaaaaccaaggctgtaactacagtgctatgacaaaggatgcactatttaagcactatggtaaaattcatcaatacactccagaaatgattcttgaaattaagaagaatcaattgaaatttgctccctttaaatgtgtagtacctacatgtacaaaaacatttacaagaaattctaacctccgggcacactgtcagttggtgcatcattttacaactgaagaaatggtaaagttaaaaattaaaaggccttatggaagaaaatctcagagtgaaaatgtgccggcctcacgaagtacacaagtgaaaaaacagctagctatgacagaggaaaataaaaaggaatctcagcctgctttagaattgagagcagagacccaaaatacccacagtaatgtagcagtgatcccagaaaaacaacttgtagaaaaaaaaagtcctgacaaaacagaaagttctttacaagtgattacagttacttcagaacaatgtaatacaaatgcactcacaaacacacaaaccaaaggacggaagattaggaggcataaaaaagaaaaggaggagaaaaaacgaaagaagccagtttcccaatcccttgagtttccaacaagatacagtccttacagaccttatcgatgtgttcaccagggatgctttgctgcctttacgatacagcaaaacttgattctccattaccaggctgtacacaaatcagatctacctgcattttcagcagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttcatgaaatgactcctgaagaaattgaaagtatgactgcttcagtggatgttgggaagtttccatgtgaccagttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcaggaagataacctctgccagtcagaaagacaaaaagcaagtaatttgaagagagttaataaggaaaaaaatgtctcacaaaataaaaaaaggaaagttgaaaaagctgaaccagcatcagcagctgagttaagtagcgtgcgtaaagaagaagaaactgctgttgccattcaaaccattgaggagcatcctgcatcttttgactggagctcttttaagccaatgggatttgaagtatcatttctgaagtttcttgaggagtctgcagtgaagcagaagaaaaatactgacaaagaccatccgaatactggaaacaaaaaaggatcccattcaaattcaagaaaaaatattgataagactgctgtgactagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgttatgaaagatatcagtataggtaaagccacaggcagaggtcagtactgataattaatgtagtataaatacatcatttaccattttattttaaataggaagccatcaagcatgctagaattgtgaaactttcattatatttttttgttgttgacatgaattaacctggc

SEQ ID NO: 202060 - DNA, 10610 bp, Homo sapiens
  Payload ID: 19860
  Gene Name: zinc finger protein 292
  Uniprot ID: O60281
  ENST ID: ENST00000369577
  CDS Start-End: 44-8215
atcacgtgacccaggtgcgtacgcgacggagcggggtgtgaagatggcggacgaagaggccgagcaggagaggttgagttgcggcgaaggcggctgcgtcgcggagctgcagcgcctgggcgagcggctccaggagctggagctacagctgcgggagagccgggtaccggccgtggaagcggccaccgactactgtcagcagctgtgccagacactcctagaatatgcagagaaatggaaaacttcagaagatcctttacctttattggaggtatacacagtggctatccaaagttatgttaaagcccgaccttatcttacctctgaatgtgaaaatgtagccttggttctggaacgcttggcattaagctgtgttgaacttttactgtgtctgcctgttgagttatcagataaacagtgggaacaatttcagacactggtgcaggtagctcatgaaaagctgatggagaatggcagctgtgaattgcattttttagctactctagctcaagagactggggtgtggaaaaacccggtactgtgcactattctttcccaggaaccattggataaggataaagtgaatgaatttttagcttttgagggtcccatcttgttggatatgagaattaaacatctaatcaaaacaaatcagttaagtcaagcaactgctctagcaaagctgtgttctgaccatccagagattggcataaaaggtagttttaagcaaacttaccttgtctgtctttgtacatcatcaccaaatggaaagttaatcgaagagatttcagaagttgattgcaaagatgcactggaaatgatctgtaacttagaatctgagggtgatgaaaaaagcgctcttgttttatgtactgcgtttttgtcacgtcagctccaacaaggagatatgtactgcgcttgggaacttactctcttttggagtaaattacaacaaagagtagaaccatctatacaagtgtaccttgagaggtgtcgtcaactttctttgttaacgaaaacagtatatcacattttcttcctgattaaagttattaattcagagactgaaggggctggacttgctacctgtatagaactgtgtgtaaaggctcttcgcttggagtctacagaaaatactgaagtgaaaatatctatttgcaagaccatttcatgtttgttgcctgatgatctggaagttaaacgtgcttgtcaactgagtgaatttcttattgagcctacagtagatgcgtattatgctgtggaaatgttgtataatcagccagaccagaaatatgatgaagagaatcttccaataccaaattctttacgctgtgagctgttacttgtattgaaaactcaatggccctttgatccagaattctgggattggaaaaccttgaaacgacaatgtcttgcattaatgggagaagaagcatccattgtgtcttcaatagatgaactaaatgacagtgaagtatatgaaaaagtggtagactaccaagaagagagtaaagaaacttctatgaatgggctttctggtggagttggtgctaattctggccttcttaaagacattggtgatgaaaagcagaagaagagagagataaaacagttaagagagaggggatttatatctgctcggtttaggaattggcaagcctacatgcagtattgtgtgttgtgtgacaaagaattccttggtcacagaatagtacgacatgctcagaaacattacaaagatggaatttatagttgccccatatgtgcaaagaactttaattctaaagaaacttttgtccctcatgtcacactgcatgttaaacaatctagtaaagagagactagcagctatgaaaccattaagaagattgggaaggcctccaaagatcacaactaccaatgaaaatcagaagactaatactgtggctaaacaggagcagcgacctataaaaaagaatagtctctattcaacagattttatagtgtttaatgacaatgatggttcagatgatgagaatgatgacaaagataaatcctatgagccagaagtgattccagtccagaaaccagtacctgttaatgaatttaattgccctgtaactttttgtaaaaagggctttaagtactttaaaaatttaattgctcatgtgaaggggcataaagataatgaagacgccaagcgctttcttgaaatgcagagcaaaaaagttatttgccagtactgtaggcggcattttgtgagtgttactcatctcaatgatcacttacagatgcactgtggcagtaaaccatatatctgtatacagatgaaatgtaaagctggttttaatagttacgccgagcttttaacccaccgaaaggagcatcaagtctttagagcaaaatgtatgtttcctaaatgtggaagaattttttcggaagcttatttactatatgatcatgaagcacaacattataatacgtacacttgtaagttcacaggttgtggtaaagtttatcgttctcagggtgagctggaaaagcatctggatgatcacagtactcctcctgaaaaagtgctgcctcctgaagcccaacttaattcatctggagattccattcagccttctgaagtgaatcagaacacagcagagaatattgagaaagaaagatctatgcttccttcagaaaataacattgaaaacagcttactagcagatagaagtgatgcttgggataaaagcaaagcagaatcagctgtgaccaaacaagaccagatttctgcctctgagctcaggcaagctaatggaccattgtcaaatggtttggaaaaccctgctactactcctctacttcaatccagtgaagtagctgtgtccattaaggtgtctctcaatcaggggattgaggataactttggaaagcaagaaaactcaactgtggaaggcagtggtgaagcactggtcacagacttacatacgccagttgaagatacttgtaatgatttgtgtcatccaggtttccaggagagaaaagaacaagattgctttaatgatgcccatgttactcagaattctttagtaaattcagaaactctcaaaataggtgaccttaccccacaaaacttagaaagacaagtgaacaacttgatgaccttttctgtgcaaaatcaggcagcatttcaaaacaatttaccaacttccaaatttgaatgtggagataatgttaaaacatcatccaatctttataatttacctcttaagacattagaaagtattgcatttgttccaccgcagtccgacctaagtaattcattaggaactccatcagtgcctccaaaagctccagttcagaaattcagctgccaggtcgagggatgtactcgaacctataattcttcacagagtattgggaaacacatgaagacagcacaccctgaccaatatgctgcatttaaaatgcagcgcaaaagtaaaaaaggtcagaaagctaacaacttaaatacaccaaataatggaaagtttgtttattttttgccatcaccggtgaacagctcaaatccattttttacatcacagaccaaagccaatgggaatcctgcttgttcggcccagttgcagcatgtctcgccacccatttttccagctcatttagcaagtgtgtcaactccattgttgtcctcaatggaaagtgtcataaatccaaatataacttctcaggataaaaatgaacaaggtggtatgttatgttcccaaatggaaaatttacctagtactgccttgccagcacaaatggaagatctaaccaaaacagttctgcctttgaatattgacagtggctcagatcctttccttcctttacctgcagaaagtagttcaatgtctctcttcccttcaccagcagatagtgggactaattctgttttttcccaactggaaaataatacaaatcattattcctcacagattgaaggaaacactaattcctcctttctaaaggggggtaatggtgaaaatgcagtttttccttcacaagtgaatgttgcaaataacttcagtagcaccaatgcccaacagtctgcacctgaaaaagttaaaaaagaccgtgggcggggcccaaatgggaaggaaagaaaacctaagcacaacaaaagggctaaatggcctgcaattatcagagatgggaaatttatctgtagcaggtgttacagggcttttactaatcccagatcactgggtgggcacttatccaagcgatcttactgtaaaccactggatggagccgaaattgctcaagaacttctacagagtaatggacagccttctcttcttgccagcatgattctctccacaaatgcagtaaatttgcagcagccacaacaatctaccttcaatccagaagcatgttttaaagatccatcatttctacagcttcttgctgaaaatcgctcgccagcatttttaccaaatacatttcctcgatctggtgtgactaactttaataccagtgtcagtcaagaaggtagtgaaattattaaacaggctttggaaactgctggcattcccagtacatttgagggtgccgaaatgctttctcatgtttcaacaggttgtgtctctgatgcatcacaagtaaatgcaacggtgatgccaaatccaactgtaccacccctgttgcacactgtatgccatccaaacaccttgctgaccaaccagaataggacgtcaaactccaaaacttcctccattgaggaatgtagcagcttgcctgtttttccaacgaatgacttactactgaagactgttgaaaatggtttgtgctctagttcatttcctaattctggtgggccatcacaaaattttaccagtaacagttctcgtgtttctgttataagtggtcctcagaacacaagatccagtcatttaaataaaaagggaaacagtgcttctaagagaagaaagaaagttgctcctccactaattgcacctaacgcttcccaaaacttggtaacaagtgacttaacaacaatgggactcatagcaaagagtgttgaaatcccaactactaaccttcattcaaatgtaattccaacttgtgaacctcagagtttggtggaaaatctaacacagaaattaaataatgttaacaatcagttatttatgactgatgtaaaagagaatttcaaaaccagtcttgagtcccatacagtgttagcccctttaacattaaaaactgaaaatggtgattcccaaatgatggctttgaattcatgcacaacttcaataaattctgatttgcagatttctgaagacaatgttatacaaaactttgaaaagactcttgaaattattaaaactgctatgaattctcaaatacttgaggtaaaaagtggatctcagggtgctggtgaaacttcacaaaatgctcaaataaattataacattcagcttccttcagtaaacactgtgcaaaataacaaattacccgattcttctccgttttcctcctttataagtgtcatgccaacaaaaagtaacattcctcagtctgaagtatcacataaggaggatcaaatacaggaaattttagaaggcttacagaaattaaaattagaaaatgacctatccactccagcatcccaatgtgtactgataaatacatcagtgacactgactcccacgcctgttaaatcaactgcagatatcacagttattcagccagtttctgaaatgataaacattcaatttaatgacaaagttaataaaccctttgtgtgtcaaaaccaaggctgtaactacagtgctatgacaaaggatgcactatttaagcactatggtaaaattcatcaatacactccagaaatgattcttgaaattaagaagaatcaattgaaatttgctccctttaaatgtgtagtacctacatgtacaaaaacatttacaagaaattctaacctccgggcacactgtcagttggtgcatcattttacaactgaagaaatggtaaagttaaaaattaaaaggccttatggaagaaaatctcagagtgaaaatgtgccggcctcacgaagtacacaagtgaaaaaacagctagctatgacagaggaaaataaaaaggaatctcagcctgctttagaattgagagcagagacccaaaatacccacagtaatgtagcagtgatcccagaaaaacaacttgtagaaaaaaaaagtcctgacaaaacagaaagttctttacaagtgattacagttacttcagaacaatgtaatacaaatgcactcacaaacacacaaaccaaaggacggaagattaggaggcataaaaaagaaaaggaggagaaaaaacgaaagaagccagtttcccaatcccttgagtttccaacaagatacagtccttacagaccttatcgatgtgttcaccagggatgctttgctgcctttacgatacagcaaaacttgattctccattaccaggctgtacacaaatcagatctacctgcattttcagcagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttcatgaaatgactcctgaagaaattgaaagtatgactgcttcagtggatgttgggaagtttccatgtgaccagttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcaggaagataacctctgccagtcagaaagacaaaaagcaagtaatttgaagagagttaataaggaaaaaaatgtctcacaaaataaaaaaaggaaagttgaaaaagctgaaccagcatcagcagctgagttaagtagcgtgcgtaaagaagaagaaactgctgttgccattcaaaccattgaggagcatcctgcatcttttgactggagctcttttaagccaatgggatttgaagtatcatttctgaagtttcttgaggagtctgcagtgaagcagaagaaaaatactgacaaagaccatccgaatactggaaacaaaaaaggatcccattcaaattcaagaaaaaatattgataagactgctgtgactagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgttatgaaagatatcagtataggtaaagccacaggcagaggtcagtactgataattaatgtagtataaatacatcatttaccattttattttaaataggaagccatcaagcatgctagaattgtgaaactttcattatatttttttgttgttgacatgaattaacctggccaaaaacaaaaaagaaaaaaaaaacatgacatttgtcatgtaaaacttttttttatccctatgggacttgaggaacagaatcagtacttcagttattgtaaatagtgagctaaacctcaaatttctatcacccagttgcccttttcatgaactaaacaattatctgtgtgattggtatgtttcaccaggtcactgctcatgtataacagtactctttatttgtagataccttttttgtatatatttattattgtaaatcatgtgctgccaccagcagtctgtaagtctaaactattaaatgacacatttatatttggaattttaatttttaactaagcgatcaagttttttaaattgttcttttattgttttaaattaagaactttttgaactaaaaccagaaactctgccatagttcattgatttttacatgaaacatttatttacaagatgatatcaagattacttttcacaaaataggcacattatatcaacactttgctctgctttgtaaatttgccatccaggattttggggtggtattcatgtgaaattaaagcagattctctagcagtttcctatagctacagtttttttttttcattgcttctaattggatatagttactatgagtccatgaaatacaatggaaatgtgaataaagaatttactacattgaagattttaaacatttggtattaaaaaaaaatcctttgtgaatgtgatagaaaactagtagtgtggagcagtgtaaatatttgaggtggtgatttgtgaagtagcccagtattgccttaaataaaatcacatttcatttcttgttttatacatgtgatcttataaagattttttgttttgttttgttttccattttctgagatttatagattggtgtatagctttaaactgtataaagttttgtggaaagatttttttaaacatttttataaatcttaaaattgatatcatcaaagtgagcccatcttgtgtttataaaatacaagagtccttaacatttataattacatagataaaacactttctataaggaagttggatgttttgattttactgtttatagatgttagattgtacagatttgtctgtatttctcaccatatctaatgatacttttttcattagattggtcttcaagaacagtattagttataattattttggttattcagtatatagttagctcttacagtttagctttattcaccatatttatactgtggattcacagcgagaggtagaggttattccaggagagttgatgaccttcatttaaagtccaactaaaatcagtagtagaaacataagaaaacatctttgcaatatttacttttgtttctgtttgccgtaaatagtaacattgtttttttttattttgtgtttgttataaaacagttgcattcacaatattattggcctgagatattgatgatattgtgatggtatgaaaatgtgtacattccctgtgcaacatcagatttgcaggaaaaatgaagcacttactgaaatcgctggtactctgaataaataagcatggtcaaggagtgaactattttcttttggaaatttctttttaatttttattattaaagtattttatttttagggccttttgggttttattgaatagttcatttcacctgtttaagacttactaccaataagcataaaacctgacacgttaaaatccctgccctttggtgagcccactgttatttattaaaataaaagttattttatgggtgattaatacatgggttttctttttcctaaattaacaataatttaaataactgagtaattttaatattaaatttttgttaacaactgaatgtttccatacagttttcttagaaattgacctagctcttaaaggtgggcacttggcaaaactgccctatatagcacagtagcaagtaggtttatttctgatcattgtaactatgagccactgttaagtgaaaatgccaatgtattggggcttttcttttgctcattagcttaagaaaatttataactagacatttctaattgttttacatgtcatggggaagagtttgccaacatttaatgaaatttttatattccaggtaatgtatactaaaggtaattatgagagtgggctttttagcatgaaacaaaaaaaatcaaactatggtaaaaagacatgaatttatagaatagcatgttggtaaattttgatacggaatgtaatgtctaagtattaaaaaatcataaaatatatttttttcatggta

SEQ ID NO: 202061 - DNA, 838 bp, Homo sapiens
  Payload ID: 19860
  Gene Name: zinc finger protein 292
  ENST ID: ENST00000466062
  CDS Start-End: 1-397
agagatttcagaagttgattgcaaagatgcactggaaatgatctgtaacttagaatctgagggtgatgaaaaaagcgctcttgttttatgtactgcgtttttgtcacgtcagctccaacaaggagatatgtactgcgcttgggaacttactctcttttggagtaaattacaacaaagagtagaaccatctatacaagtgtaccttgagaggtgtcgtcaactttctttgttaacgaaaacagtatatcacattttcttcctgattaaagttattaattcagagagatggggtctcactatattgcccagatttatctccaactcctgggctcaagtaattctccgtgccttggccttccaaagtggtgggattacaggtatgagccaccacacatgaccttcgcagcagccttcttgacagggatagtatgcaccatgactgaaggggctggacttgctacctgtatagaactgtgtgtaaaggctcttcgcttggagtctacagaaaatactgaagtgaaaatatctatttgcaagaccatttcatgtttgttgcctgatgatctggaagttaaacgtgcttgtcaactgagtgaatttcttattgagcctacagtagatgcgtattatgctgtggaaatgttgtataatcagccagaccagaaatatgatgaagagaatcttccaataccaaattctttacgctgtgagctgttacttgtattgaaaactcaatggccctttgatccagaattctgggattggaaaaccttgaaacgacaatgtcttgcattaatgggagaagaagcatccattgtgtcttcaatagatgaactaa

SEQ ID NO: 202062 - DNA, 770 bp, Homo sapiens
  Payload ID: 19860
  Gene Name: zinc finger protein 292
  ENST ID: ENST00000496806
  CDS Start-End: 1-770
gttgagttgcggcgaaggcggctgcgtcgcggagctgcagcgcctgggcgagcggctccaggagctggagctacagctgcgggagagccgggtaccggccgtggaagcggccaccgactactgtcagcagctgtgccagacactcctagaatatgcagagaaatggaaaacttcagaagatcctttacctttattggagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttcatgaaatgactcctgaagaaattgaaagtatgactgcttcagtggatgttgggaagtttccatgtgaccagttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaa

SEQ ID NO: 202063 - DNA, 277 bp, Homo sapiens
  Payload ID: 19860
  Gene Name: zinc finger protein 292
  ENST ID: ENST00000518845
  CDS Start-End: 17-277
ggagcggggtgtgaagatggcggacgaagaggccgagcaggagaggttgagttgcggcgaaggcggctgcgtcgcggagctgcagcgcctgggcgagcggctccaggagctggagctacagctgcgggagagccgggtaccggccgtggaagcggccaccgactactgtcagcagctgtgccagatttcagaagttgattgcaaagatgcactggaaatgatctgtaacttagaatctgagggtgatgaaaaaagcgctcttgttttatgtactgcg

SEQ ID NO: 202064 - DNA, 1096 bp, Homo sapiens
  Payload ID: 19860
  Gene Name: zinc finger protein 292
  ENST ID: ENST00000392985
  CDS Start-End: 238-438
atggaacaggtcttcgaatctccccaggaacatctcagaggatatgtccgtagaagacttcgtggactggggaaagccacgccgggatcgggacgccggagagggtcgcccctccctaggctttttcccgtcgcggcgcccacgtgaccgagagcaggccttcaccagcccgcccctttcggccgctgctgcccacttcccgctcggggtgcgtacgcgacggagcggggtgtgaagatggcggacgaagaggccgagcaggagaggttgagttgcggcgaaggcggctgcgtcgcggagctgcagcgcctgggcgagcggctccaggagctggagctacagctgcgggagagccgggtaccggccgtggaagcggccaccgactactgtcagcagctgtgccagggtctcactgtcacccaggctggaatgcagtgacgccatcagagctcacttcagcgtccacctcccgggctcaagtgatcctcccacctcagcctcttggatagctgggactacagatgtgcgctaccatgcccagctgatttttggaaattttagtggagacagggttttgccatgttgcccagactggtcttgatctcctgggctcaagcaatttgcccatctcagactcccagagtgctgggattacaggcgtgagccaccgtgcccagcctagaatttgtatatactcaaaatagtttacattttgcatttttctacatgaacatatgcatgtattgctgatctttccctactttttgcaaatatgatagatttcactatatacaaaacttaaaacattatacattaactcaaaagcattgtcaatttatattctgaaataatgcaaattttaatttttttaaaaacaaaacttctacaagattattatattattttaggagactaaaacataaaagcctgatacttaagtagtttgaatctggtgatttattccatgacttaacctattcatatttgtataatcttattttaagccttggcttgggattttttttaattgcctccctaaaataggatagtgcacattgcataaaatgacattgtcaataaaatttatatcctcaaa

SEQ ID NO: 202065 - DNA, 1744 bp, Homo sapiens
  Payload ID: 19861
  Gene Name: zinc finger protein 296
  Uniprot ID: Q8WUU4
  ENST ID: ENST00000303809
  CDS Start-End: 216-1643
cgccgtcagggccccagcagggcggctcggtcccctcccatgagccccgccctggtaggcggagccacgggcccggccagcacgtgtaagagttcgcggcgggtcgccgcagtcactcacctgagcgcgcacggtccgcgcgtcctccgctcgtgcgtcctccgcccgcccgcctgcctgcctgcccgcccgctcgctcgcccggcccgcgactcatgtcccgccgcaaggccggcagcgcgccccgccgagtagagcccgcgcccgccgccaacccagacgacgagatggaaatgcaggacctcgtcatcgaactcaagcccgagccagacgcgcagccccaacaggccccaaggctggggcccttctccccgaaggaggtgtcctcggcggggcggttcggcggcgaaccccaccactcccctggccccatgcccgccggggccgccctcctcgccctcggcccgcggaacccgtggaccctgtggacgccgttgaccccgaactatcccgaccgccagccctggaccgacaaacacccagatctgttgacctgcggccgctgcctgcagaccttcccgttggaggccatcactgccttcatggaccacaagaagctgggctgtcagctcttcagaggccccagccgcggccagggctcagaacgagaggagctgaaggccttgagctgcctgcgctgtggcaaacagttcacagtggcctggaagctgctgcgtcacgcccagtgggaccacggactgtccatctaccagacagaatcagaggccccggaggccccgctcctgggcctggccgaggtggctgcagccgtgtcggcagtggtggggccagcagctgaggccaagagcccccgtgcaagtggcagcggcctcacccggcggagccccacctgtcctgtgtgcaagaagaccctcagctccttcagcaacctcaaagtgcacatgcgctcacacacaggcgagcggccctatgcttgcgaccagtgtccctacgcctgcgcccagagcagcaagctcaaccgccacaagaagacccaccggcaggtgccgccccagagccccctcatggccgacaccagccaggagcaggcctctgcagcccctccggagccggctgtccatgctgctgcccccaccagcacccttccatgcagcggtggtgagggggctggagccgccgccacagcaggtgtccaggaacccggggctcctggcagtggggctcaagccggccctggtggagacacttggggagccatcaccacggaacaaagaactgaccctgcaaacagccagaaggcatcacccaaaaagatgcccaagtcagggggcaagagccgcgggcccgggggcagctgtgagttctgcgggaagcattttaccaacagcagcaacctgacggtgcaccggcgctcacacaccggggagcgcccctacacctgtgagttctgcaactacgcctgcgcccagagcagtaagctcaaccgccaccgccgcatgcacggcatgacgcctggcagcacccgcttcgagtgcccccactgccatgtgcccttcggcctgcgagccaccctggacaaacacctgcggcagaagcaccctgaggcggccggcgaggcctgagcccaggaaagcccccctcactgtccctggtaccgctgccaacacccattgacctcctcgtttttgcccgccttctccaagtaaattttcccttttattta

SEQ ID NO: 202066 - DNA, 1631 bp, Homo sapiens
  Payload ID: 19861
  Gene Name: zinc finger protein 296
  ENST ID: ENST00000622376
  CDS Start-End: 176-1531
gccgtcagggccccagcagggcggctcggtcccctcccatgagccccgccctggtaggcggagccacgggcccggccagcacgtgtaagagttcgcggcgggtcgccgcagtcactcacctgagcgcgcacggtccgcgcgtcctccgctcgtgcgtcccaacccagacgacgagatggaaatgcaggacctcgtcatcgaactcaagcccgagccagacgcgcagccccaacaggccccaaggctggggcccttctccccgaaggaggtgtcctcggcggggcggttcggcggcgaaccccaccactcccctggccccatgcccgccggggccgccctcctcgccctcggcccgcggaacccgtggaccctgtggacgccgttgaccccgaactatcccgaccgccagccctggaccgacaaacacccagatctgttgacctgcggccgctgcctgcagaccttcccgttggaggccatcactgccttcatggaccacaagaagctgggctgtcagctcttcagaggccccagccgcggccagggctcagaacgagaggagctgaaggccttgagctgcctgcgctgtggcaaacagttcacagtggcctggaagctgctgcgtcacgcccagtgggaccacggactgtccatctaccagacagaatcagaggccccggaggccccgctcctgggcctggccgaggtggctgcagccgtgtcggcagtggtggggccagcagctgaggccaagagcccccgtgcaagtggcagcggcctcacccggcggagccccacctgtcctgtgtgcaagaagaccctcagctccttcagcaacctcaaagtgcacatgcgctcacacacaggcgagcggccctatgcttgcgaccagtgtccctacgcctgcgcccagagcagcaagctcaaccgccacaagaagacccaccggcaggtgccgccccagagccccctcatggccgacaccagccaggagcaggcctctgcagcccctccggagccggctgtccatgctgctgcccccaccagcacccttccatgcagcggtggtgagggggctggagccgccgccacagcaggtgtccaggaacccggggctcctggcagtggggctcaagccggccctggtggagacacttggggagccatcaccacggaacaaagaactgaccctgcaaacagccagaaggcatcacccaaaaagatgcccaagtcagggggcaagagccgcgggcccgggggcagctgtgagttctgcgggaagcattttaccaacagcagcaacctgacggtgcaccggcgctcacacaccggggagcgcccctacacctgtgagttctgcaactacgcctgcgcccagagcagtaagctcaaccgccaccgccgcatgcacggcatgacgcctggcagcacccgcttcgagtgcccccactgccatgtgcccttcggcctgcgagccaccctggacaaacacctgcggcagaagcaccctgaggcggccggcgaggcctgagcccaggaaagcccccctcactgtccctggtaccgctgccaacacccattgacctcctcgtttttgcccgccttctccaagtaaattttcccttttattt

SEQ ID NO: 202067 - DNA, 512 bp, Homo sapiens
  Payload ID: 19862
  Gene Name: zinc finger protein 3
  ENST ID: ENST00000292393
  CDS Start-End: 451-512
gggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtggtgaggaataaggactcattcattcttttactcagtcattctgcaatcatccattgaaatcgctcacttaccagctcttccttcaaaagttcctgccttttccgacaaggacagcctgggggatgagatgttggcggctgcgctcctaaaggccaagtcccaggagctggtaacctttgaggatgtagc

SEQ ID NO: 202068 - DNA, 2799 bp, Homo sapiens
  Payload ID: 19862
  Gene Name: zinc finger protein 3
  Uniprot ID: P17036
  ENST ID: ENST00000299667
  CDS Start-End: 304-1644
gggaacttccgttctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactggagaaaaaccctatgaatgtaatgaatgtgggaaagccttcagccagagctcacacctctatcagcaccagagaatccacactggagagaagccctacgaatgtatggaatgtggaggaaagtttacctacagttcaggccttattcagcatcaaagaatccacaccggggagaacccctatgaatgtagtgagtgtgggaaagccttcaggtacagctcggctcttgttcgccatcagagaattcacactggagagaagcctttgaatgggatcggcatgagcaaaagctccctcagagttacgaccgagttaaatatcagagagtccacgtgaaagagccacacacccattttcctcactttccctgagtctcaagagctcttgccttaccctataaatctcaacagcttaggatgtgtccctttcaactcagacttttcattttagagaatggggcagatggggcaaatcgttgaattttcccagaaatcacaccagccttagaaagcgtcaaggcaagtggatggcgtgctgggaatagaaagcagctctgggaccagttaccccatttaggaaaggagtttgcactaaactgtttttctcacagcagaggaacctttccaaggtggggatggaagcacagtcgggacagaattcgatggattcctttagttggagtccgcgtagtcagcacagacagcagtggaaaggacgctctgggtcctgttatttgctagggagggtaaagggagactatttcaaagctactgttcctagtccagctttaagtttcggtaagaaacatgctgttttgtttcatgatttcgttaattatggaaatttggcattgagggattattttattgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgccctgccctctcacctctgacacccagccccaggagccagaccactcctgcctccacctctgactcttcagcagctgaagattaatgcagagaaagagcaaagcccaaaagggagaaaaaaaaaacaaaaaaacaaaaaaacgaagcccagagaaggcaggctgtgcctgagcctggtagcagagctcgttgctgggtgaggatggcactccccgagttttcccaaccgacgggatgaccttccattgtgttttcccaaccctgctcatcctgtagcataaatgaagtgcactattaaacagaa

SEQ ID NO: 202069 - DNA, 3473 bp, Homo sapiens
  Payload ID: 19862
  Gene Name: zinc finger protein 3
  Uniprot ID: P17036
  ENST ID: ENST00000303915
  CDS Start-End: 969-2309
gatatgatggttggctctgagacaccattgaagggaccctgctaggagggcgatggtggcaagaaggtgtgtcaccttgattgccagtggcctggcttgtgcctgagtcagtgctttccactgtgtaagggctctggtattggacattctatatcccctgctacccgaagaccagagttgcccaaacttgcgactgactttcaaacaggacccctcttcctttgttctttttttttcttttattctctcaaacattctcttatccattcctcttcctttgatgccttatgtgagtgtaacagtctgtaattatgaagcacatactttttgcattcccgatttttttactccttgcagttgtgagtggcaatagagttagccctcagcaaacatttgctatgtgagcaaatgagtaaagagataatgagaggtagatcaaatccagggttggttggtttgttttgttttgttttgttttgtttgagagagaatcgcttgaacccgggaggcagaggtggcagtgagatgagattgcgccattgcactccagcctgggtgacaagagtgaaattccgtcttaaaaaaaataaagaaaatttaaaaataccgggcgcggtggctcacgcctgtaatcccagctctcagggaggcaacaggtgggaggatagcttgagcccaggagttccagacctgcctgggcaatatagcgagaccctgttctccacaaaaaggaaaaaaaaaattaaaaaataaaagaaaataaaagactagtcccagttgccacatttcttctcactgttcctgggtactcactgaaatactagctcccatctttctgtattcaggaggtttttttgaattatctttgaaccttgaacttttgcttctgcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactggagaaaaaccctatgaatgtaatgaatgtgggaaagccttcagccagagctcacacctctatcagcaccagagaatccacactggagagaagccctacgaatgtatggaatgtggaggaaagtttacctacagttcaggccttattcagcatcaaagaatccacaccggggagaacccctatgaatgtagtgagtgtgggaaagccttcaggtacagctcggctcttgttcgccatcagagaattcacactggagagaagcctttgaatgggatcggcatgagcaaaagctccctcagagttacgaccgagttaaatatcagagagtccacgtgaaagagccacacacccattttcctcactttccctgagtctcaagagctcttgccttaccctataaatctcaacagcttaggatgtgtccctttcaactcagacttttcattttagagaatggggcagatggggcaaatcgttgaattttcccagaaatcacaccagccttagaaagcgtcaaggcaagtggatggcgtgctgggaatagaaagcagctctgggaccagttaccccatttaggaaaggagtttgcactaaactgtttttctcacagcagaggaacctttccaaggtggggatggaagcacagtcgggacagaattcgatggattcctttagttggagtccgcgtagtcagcacagacagcagtggaaaggacgctctgggtcctgttatttgctagggagggtaaagggagactatttcaaagctactgttcctagtccagctttaagtttcggtaagaaacatgctgttttgtttcatgatttcgttaattatggaaatttggcattgagggattattttattgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgccctgccctctcacctctgacacccagccccaggagccagaccactcctgcctccacctctgactcttcagcagctgaagattaatgcagagaaagagcaaagcccaaaagggagaaaaaaaaaacaaaaaaacaaaaaaacgaagcccagagaaggcaggctgtgcctgagcctggtagcagagctcgttgctgggtgaggatggcactccccgagttttcccaaccgacgggatgaccttccattgtgttttcccaaccctgctcatcctgtagcataaatgaagtgcactattaaacagaatagtttttc

SEQ ID NO: 202070 - DNA, 999 bp, Homo sapiens
  Payload ID: 19862
  Gene Name: zinc finger protein 3
  ENST ID: ENST00000428683
  CDS Start-End: 446-999
agtggtgcgatgtcggctcactgcaacctccgcctcctgggttcaagcgattctcctgtctcagcctccagagtagctgggattacaggcgtctgccaccacgcccgggtaatttttttgtatttttagtcgagacggggtttcgccatgttggccaggctggtctcgaactcctgacctcaggtgatccgcccgcctcggcctcctaaagtgctgggattacaggcgtgagcctccgcgcccggccgcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattc

SEQ ID NO: 202071 - DNA, 574 bp, Homo sapiens
  Payload ID: 19862
  Gene Name: zinc finger protein 3
  ENST ID: ENST00000441298
  CDS Start-End: 279-574
gaacttccgttctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcag

SEQ ID NO: 202072 - DNA, 1441 bp, Homo sapiens
  Payload ID: 19862
  Gene Name: zinc finger protein 3
  Uniprot ID: P17036
  ENST ID: ENST00000413658
  CDS Start-End: 291-686
ctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggactggatacacgtctgtttaactacgcaaaaggtaatgctggcatggcttactgggaccctaagtgtggcgaagggactctgctccagtgaactggcgagtgtggaacctcctgacaccttctgaggacctcctgcctgccatgttgctgtggagctcgcactcctcaggcatcccctgatgttgagtgatacaaactctatcaccggaatcgatgctgctgcaatgacaagacttctttctggttttcagattctaaagtttaaaacaacgacaacaacaggagcgcttgaaagttacggtgcttctccctctccagtgtggactcgctgatgtttggaaagattggacttgctacagaaggtctttccacagtgatgacaccagtagggcttttccccggtgtggattctgtggtgtttattgaagttggagctgtggttgaaggctttcccacactccttacacttatatggcttctctccggtgtggagtctctggtgggagctgaggcccgcatgctgactgaagctcttcccacattcgttacactgataaggcttctccccagtgtggatccgatagtgacgaatgaggctgcctttcccgctgaaagccttgccacaatctttgcactgatatggcgcctcttctgtgtgcattctctgatgtttaagaaggtctgagctctgcccaaaagcttttccacacttacagtcatagggccggtccaccaagtgtgttctgtagtggagggtgaggtttgagctgtggctgaaagctttcccacacttggtgcacacgtaaggtttctccccagtgtgtgttctcctgtgtttggtgagatttgagctattactaaaggctttgccacattcagc

SEQ ID NO: 202073 - DNA, 735 bp, Homo sapiens
  Payload ID: 19862
  Gene Name: zinc finger protein 3
  ENST ID: ENST00000449785
  CDS Start-End: 182-735
ggaacttccgttctttgttctgtccccggtgtgtgggtctgtgacagggtccaacagggcctggtccgtgtccggtcccccaaatctgtcgtccctgcccccaggtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattc

SEQ ID NO: 202074 - DNA, 2718 bp, Homo sapiens
  Payload ID: 19862
  Gene Name: zinc finger protein 3
  Uniprot ID: P17036
  ENST ID: ENST00000424697
  CDS Start-End: 207-1547
aaccgacccggaagcgaaacgagggggaacttccgttctttgttctgtccccggtgtgtgggtctgtgacagggtccaacagggcctggtccgtgtccggtcccccaaatctgtcgtccctgcccccaggtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactggagaaaaaccctatgaatgtaatgaatgtgggaaagccttcagccagagctcacacctctatcagcaccagagaatccacactggagagaagccctacgaatgtatggaatgtggaggaaagtttacctacagttcaggccttattcagcatcaaagaatccacaccggggagaacccctatgaatgtagtgagtgtgggaaagccttcaggtacagctcggctcttgttcgccatcagagaattcacactggagagaagcctttgaatgggatcggcatgagcaaaagctccctcagagttacgaccgagttaaatatcagagagtccacgtgaaagagccacacacccattttcctcactttccctgagtctcaagagctcttgccttaccctataaatctcaacagcttaggatgtgtccctttcaactcagacttttcattttagagaatggggcagatggggcaaatcgttgaattttcccagaaatcacaccagccttagaaagcgtcaaggcaagtggatggcgtgctgggaatagaaagcagctctgggaccagttaccccatttaggaaaggagtttgcactaaactgtttttctcacagcagaggaacctttccaaggtggggatggaagcacagtcgggacagaattcgatggattcctttagttggagtccgcgtagtcagcacagacagcagtggaaaggacgctctgggtcctgttatttgctagggagggtaaagggagactatttcaaagctactgttcctagtccagctttaagtttcggtaagaaacatgctgttttgtttcatgatttcgttaattatggaaatttggcattgagggattattttattgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgccctgccctctcacctctgacacccagccccaggagccagaccactcctgcctccacctctgactcttcagcagctgaagattaatgcagagaaagagcaaagcccaaaagggagaaaaaaaaaacaaaaaaacaaaaaaacgaagcccagagaaggcaggctgtgcctgagcctggtagcagagctcgttgctgggtgaggatggcactccccgagttttcccaaccgacgggatgaccttccattgtgttttcccaaccctgctcatcctgtagcataaatgaagtgcactattaaacagaatagtttttcagaagag

SEQ ID NO: 202075 - DNA, 595 bp, Homo sapiens
  Payload ID: 19862
  Gene Name: zinc finger protein 3
  ENST ID: ENST00000412947
  CDS Start-End: 150-595
gttctttgttctgtccccggtgtgtgggtctgtgacagggtccaacagggcctggtccgtgtccggtcccccaaatctgtcgtccctgcccccaggctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattc

SEQ ID NO: 202076 - DNA, 543 bp, Homo sapiens
  Payload ID: 19862
  Gene Name: zinc finger protein 3
  ENST ID: ENST00000415068
  CDS Start-End: 231-543
aaaattaaaaaataaaagaaaataaaagactagtcccagttgccacatttcttctcactgttcctgggtactcactgaaatactagctcccatctttctgtattcaggaggtttttttgaattatctttgaaccttgaacttttgcttctgcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaag

SEQ ID NO: 202077 - DNA, 2579 bp, Homo sapiens
  Payload ID: 19863
  Gene Name: zinc finger protein 30
  Uniprot ID: P17039
  ENST ID: ENST00000303586
  CDS Start-End: 379-2253
cttgtggactgcgccgggcatgctcggcggtgtgacggctcaggactgcatttcccagaggctgcagctatccggccaatgtagcctgaaactacatttctcagcggccactggaacgacctcaatctctgcctcctcgccagttcattgtggtcgttgacccggcagcgagctttggagttcatcgagggagaagtcagcgcccagctccgaggttggagcagccccgccgggcaacttgaatttctgcaaacgaacacagcaccgggagctctgcagacctgtgtcggcgcggaacccggactgagacatgccttttgaacttctcagatagaggaaccccagtgaagactgatcagttcttacaattctcaaagcatggcccataaatatgtgggtttgcagtatcacggatcagtgacatttgaggatgtggccatagccttctcccagcaggagtgggagagtctggactcttcccagaggggcttgtacagagatgtgatgttggagaactacaggaacttggtgtcaatggcaggacattcccgttctaaaccacatgtgatcgccttattggaacaatggaaagagcctgaagtgacagtgaggaaagatggaagaagatggtgcacagatttgcagttggaagatgatacaatcggctgtaaagaaatgcccacctctgaaaactgtccatcttttgctctacatcagaaaataagtagacagaaaccacgtgaatgtcaggaatatggaaagaccctttgtcaagactcaaagcctgttcaacatgaaagaatacatagtagtgaaaaacccaacagatgtaaagaatgtgggaagaactttagtaatggacatcaactcaccatacatcagagattgcatgttggtgagaaaccctataaatatgaaaaatgtgggaaggcctttatcagtggctcagcctttgttaagcatgggagaattcacactggtgagaagccactcaaatgtaagcaatgtggaaagactattagtggtagctatcaacttacagtacataagagtattcatactgggaagaaaccatatgagtgcggggaatgtgggaaagcttttctagtatatggaaagcttacccggcatcagagtactcacactggtgaaaaaccctttgggtgtgaggagtgtgggaaggccttcagtaccttttcatacctggttcaacatcagcgaattcataccagtgaaaaaccttacgaatgcaaagaatgtgggaaggcctttagcactagctcaccccttgctaagcatcagagaattcatactggcgagaaaccctatgaatgtaaggagtgtgggaagtccttcactgtgtatggacagcttactcgacatcagagtattcatactggtgagaaaccttttgaatgtaaggaatgtggaaaggcctttagacttagttccttccttcatgcacatcagcgaattcatgcagagataaagccctacggatgcaaggaatgcgggagaaccttcagtcgtgcctcatatcttgttcaacatggaagacttcacactggcgagaagccctatgaatgtaaggagtgtggcaaggcctttagtactggctcataccttgttcagcatcagaggatccatactggggagaaaccctatgaatgtaaggaatgtggcaaagcctttattagtcgccatcagcttaccgtacatcaaagggttcatactggagagaaaccctatgagtgtaaggaatgtggcaaggccttcagagtgcacgtacatctcacacagcatcggaaaattcatactgatgtaaagccctatgaatgtaaggaatgtggaaagacttttagtcgagcctcgtaccttgtacaacatagcagaatccatactggtaagaagccctatgagtgtaaggagtgtggcaaggccttcagttctggctcataccttgttcagcatcaaagaattcatactggggagaaaccctatgaatgtaacaaatgtgggaaagcctttactgtttatggacaacttattggacatcagagtgttcacactggtgagaaaccttttgaatgtaaggaatgcgggaaggcctttagacttaattcattccttactgaacatcagcgggtacacactggtgagaaaccctttaaatgcaaaaaatgtgggaagacctttagatacagttcagcccttaaagtgcatctgagaaaacatatgagtgttataccctaagagtctgaggagtgtgggaagtgcttcgtgtgtggctcaaacattgttgaacatcggggaatttatgctggtaggaaactttcaaatgtgaagaatattggcaggtctattctcatcttataattcataatataactcagaaaacataagaatattcctttgtcatttataggtttgtaataccaatatttatactggtggaccattcagaaaaagtgggaaacgttattacttaatggttacagcactgacagcatgaacttttatatgatgcatttattctaatgtgattgtatgaacaagtgaataaaaaaccttggacctcc

SEQ ID NO: 202078 - DNA, 2651 bp, Homo sapiens
  Payload ID: 19863
  Gene Name: zinc finger protein 30
  Uniprot ID: P17039
  ENST ID: ENST00000439785
  CDS Start-End: 445-2319
cttgtggactgcgccgggcatgctcggcggtgtgacggctcaggactgcatttcccagaggctgcagctatccggccaatgtagcctgaaactacatttctcagcggccactggaacgacctcaatctctgcctcctcgccagttcattgtggtcgttgacccggcagcgagctttggagttcatcgagggagaagtcagcgcccagctccgaggttggagcagccccgccgggcaacttgaatttctgcaaacgaacacagcaccgggagctctgcagacctgtgtcggcgcggaacccggactgagacatgcgtgagcgttgggtggaccgggcgaggatcccgggccggcgagtgcgggagcggcagggcagggaggcttttgaacttctcagatagaggaaccccagtgaagactgatcagttcttacaattctcaaagcatggcccataaatatgtgggtttgcagtatcacggatcagtgacatttgaggatgtggccatagccttctcccagcaggagtgggagagtctggactcttcccagaggggcttgtacagagatgtgatgttggagaactacaggaacttggtgtcaatggcaggacattcccgttctaaaccacatgtgatcgccttattggaacaatggaaagagcctgaagtgacagtgaggaaagatggaagaagatggtgcacagatttgcagttggaagatgatacaatcggctgtaaagaaatgcccacctctgaaaactgtccatcttttgctctacatcagaaaataagtagacagaaaccacgtgaatgtcaggaatatggaaagaccctttgtcaagactcaaagcctgttcaacatgaaagaatacatagtagtgaaaaacccaacagatgtaaagaatgtgggaagaactttagtaatggacatcaactcaccatacatcagagattgcatgttggtgagaaaccctataaatatgaaaaatgtgggaaggcctttatcagtggctcagcctttgttaagcatgggagaattcacactggtgagaagccactcaaatgtaagcaatgtggaaagactattagtggtagctatcaacttacagtacataagagtattcatactgggaagaaaccatatgagtgcggggaatgtgggaaagcttttctagtatatggaaagcttacccggcatcagagtactcacactggtgaaaaaccctttgggtgtgaggagtgtgggaaggccttcagtaccttttcatacctggttcaacatcagcgaattcataccagtgaaaaaccttacgaatgcaaagaatgtgggaaggcctttagcactagctcaccccttgctaagcatcagagaattcatactggcgagaaaccctatgaatgtaaggagtgtgggaagtccttcactgtgtatggacagcttactcgacatcagagtattcatactggtgagaaaccttttgaatgtaaggaatgtggaaaggcctttagacttagttccttccttcatgcacatcagcgaattcatgcagagataaagccctacggatgcaaggaatgcgggagaaccttcagtcgtgcctcatatcttgttcaacatggaagacttcacactggcgagaagccctatgaatgtaaggagtgtggcaaggcctttagtactggctcataccttgttcagcatcagaggatccatactggggagaaaccctatgaatgtaaggaatgtggcaaagcctttattagtcgccatcagcttaccgtacatcaaagggttcatactggagagaaaccctatgagtgtaaggaatgtggcaaggccttcagagtgcacgtacatctcacacagcatcggaaaattcatactgatgtaaagccctatgaatgtaaggaatgtggaaagacttttagtcgagcctcgtaccttgtacaacatagcagaatccatactggtaagaagccctatgagtgtaaggagtgtggcaaggccttcagttctggctcataccttgttcagcatcaaagaattcatactggggagaaaccctatgaatgtaacaaatgtgggaaagcctttactgtttatggacaacttattggacatcagagtgttcacactggtgagaaaccttttgaatgtaaggaatgcgggaaggcctttagacttaattcattccttactgaacatcagcgggtacacactggtgagaaaccctttaaatgcaaaaaatgtgggaagacctttagatacagttcagcccttaaagtgcatctgagaaaacatatgagtgttataccctaagagtctgaggagtgtgggaagtgcttcgtgtgtggctcaaacattgttgaacatcggggaatttatgctggtaggaaactttcaaatgtgaagaatattggcaggtctattctcatcttataattcataatataactcagaaaacataagaatattcctttgtcatttataggtttgtaataccaatatttatactggtggaccattcagaaaaagtgggaaacgttattacttaatggttacagcactgacagcatgaacttttatatgatgcatttattctaatgtgattgtatgaacaagtgaataaaaaaccttggacctcctaaacc

SEQ ID NO: 202079 - DNA, 2280 bp, Homo sapiens
  Payload ID: 19863
  Gene Name: zinc finger protein 30
  Uniprot ID: P17039
  ENST ID: ENST00000601142
  CDS Start-End: 238-2109
agttcattgtggtcgttgacccggcagcgagctttggagttcatcgagggagaagtcagcgcccagctccgaggttggagcagccccgccgggcaacttgaatttctgcaaacgaacacagcaccgggagctctgcagacctgtgtcggcgcggaacccggactgagacatgccttttgaacttctcagatagaggaaccccagtgaagactgatcagttcttacaattctcaaagcatggcccataaatatgtgggtttgcagtatcacggatcagtgacatttgaggatgtggccatagccttctcccagcaggagtgggagagtctggactcttcccagaggggcttgtacagagatgtgatgttggagaactacaggaacttggtgtcaatgggacattcccgttctaaaccacatgtgatcgccttattggaacaatggaaagagcctgaagtgacagtgaggaaagatggaagaagatggtgcacagatttgcagttggaagatgatacaatcggctgtaaagaaatgcccacctctgaaaactgtccatcttttgctctacatcagaaaataagtagacagaaaccacgtgaatgtcaggaatatggaaagaccctttgtcaagactcaaagcctgttcaacatgaaagaatacatagtagtgaaaaacccaacagatgtaaagaatgtgggaagaactttagtaatggacatcaactcaccatacatcagagattgcatgttggtgagaaaccctataaatatgaaaaatgtgggaaggcctttatcagtggctcagcctttgttaagcatgggagaattcacactggtgagaagccactcaaatgtaagcaatgtggaaagactattagtggtagctatcaacttacagtacataagagtattcatactgggaagaaaccatatgagtgcggggaatgtgggaaagcttttctagtatatggaaagcttacccggcatcagagtactcacactggtgaaaaaccctttgggtgtgaggagtgtgggaaggccttcagtaccttttcatacctggttcaacatcagcgaattcataccagtgaaaaaccttacgaatgcaaagaatgtgggaaggcctttagcactagctcaccccttgctaagcatcagagaattcatactggcgagaaaccctatgaatgtaaggagtgtgggaagtccttcactgtgtatggacagcttactcgacatcagagtattcatactggtgagaaaccttttgaatgtaaggaatgtggaaaggcctttagacttagttccttccttcatgcacatcagcgaattcatgcagagataaagccctacggatgcaaggaatgcgggagaaccttcagtcgtgcctcatatcttgttcaacatggaagacttcacactggcgagaagccctatgaatgtaaggagtgtggcaaggcctttagtactggctcataccttgttcagcatcagaggatccatactggggagaaaccctatgaatgtaaggaatgtggcaaagcctttattagtcgccatcagcttaccgtacatcaaagggttcatactggagagaaaccctatgagtgtaaggaatgtggcaaggccttcagagtgcacgtacatctcacacagcatcggaaaattcatactgatgtaaagccctatgaatgtaaggaatgtggaaagacttttagtcgagcctcgtaccttgtacaacatagcagaatccatactggtaagaagccctatgagtgtaaggagtgtggcaaggccttcagttctggctcataccttgttcagcatcaaagaattcatactggggagaaaccctatgaatgtaacaaatgtgggaaagcctttactgtttatggacaacttattggacatcagagtgttcacactggtgagaaaccttttgaatgtaaggaatgcgggaaggcctttagacttaattcattccttactgaacatcagcgggtacacactggtgagaaaccctttaaatgcaaaaaatgtgggaagacctttagatacagttcagcccttaaagtgcatctgagaaaacatatgagtgttataccctaagagtctgaggagtgtgggaagtgcttcgtgtgtggctcaaacattgttgaacatcggggaatttatgctggtaggaaactttcaaatgtgaagaatattggcaggtctattctcatcttataattcataatataactcagaaaacataagaatattcctttgtcatttata

SEQ ID NO: 202080 - DNA, 2583 bp, Homo sapiens
  Payload ID: 19863
  Gene Name: zinc finger protein 30
  Uniprot ID: P17039
  ENST ID: ENST00000601957
  CDS Start-End: 302-562
aatgtagcctgaaactacatttctcagcggccactggaacgacctcaatctctgcctcctcgccagttcattgtggtcgttgacccggcagcgagctttggagttcatcgagggagaagtcagcgcccagctccgaggttggagcagccccgccgggcaacttgaatttctgcaaacgaacacagcaccgggagctctgcagacctgtgtcggcgcggaacccggactgagacatgccttttgaacttctcagatagaggaaccccagtgaagactgatcagttcttacaattctcaaagcatggcccataaatatgtgggtttgcagtatcacggatcagtgacatttgaggatgtggccatagccttctcccagcaggagtgggagagtctggactcttcccagaggggcttgtacagagatgtgatgttggagaactacaggaacttggtgtcaatgggacattcccgttctaaaccacatgtgatcgccttattggaacaatggaaagagcctgaagtgacagtgaggaaagatggaagaagatggtgcacaggataagaaagctccagtctacaaacaaaacatgccagaagatttttaggcgatgatgccacctgcacatggaaccaaaagatttgcagttggaagatgatacaatcggctgtaaagaaatgcccacctctgaaaactgtccatcttttgctctacatcagaaaataagtagacagaaaccacgtgaatgtcaggaatatggaaagaccctttgtcaagactcaaagcctgttcaacatgaaagaatacatagtagtgaaaaacccaacagatgtaaagaatgtgggaagaactttagtaatggacatcaactcaccatacatcagagattgcatgttggtgagaaaccctataaatatgaaaaatgtgggaaggcctttatcagtggctcagcctttgttaagcatgggagaattcacactggtgagaagccactcaaatgtaagcaatgtggaaagactattagtggtagctatcaacttacagtacataagagtattcatactgggaagaaaccatatgagtgcggggaatgtgggaaagcttttctagtatatggaaagcttacccggcatcagagtactcacactggtgaaaaaccctttgggtgtgaggagtgtgggaaggccttcagtaccttttcatacctggttcaacatcagcgaattcataccagtgaaaaaccttacgaatgcaaagaatgtgggaaggcctttagcactagctcaccccttgctaagcatcagagaattcatactggcgagaaaccctatgaatgtaaggagtgtgggaagtccttcactgtgtatggacagcttactcgacatcagagtattcatactggtgagaaaccttttgaatgtaaggaatgtggaaaggcctttagacttagttccttccttcatgcacatcagcgaattcatgcagagataaagccctacggatgcaaggaatgcgggagaaccttcagtcgtgcctcatatcttgttcaacatggaagacttcacactggcgagaagccctatgaatgtaaggagtgtggcaaggcctttagtactggctcataccttgttcagcatcagaggatccatactggggagaaaccctatgaatgtaaggaatgtggcaaagcctttattagtcgccatcagcttaccgtacatcaaagggttcatactggagagaaaccctatgagtgtaaggaatgtggcaaggccttcagagtgcacgtacatctcacacagcatcggaaaattcatactgatgtaaagccctatgaatgtaaggaatgtggaaagacttttagtcgagcctcgtaccttgtacaacatagcagaatccatactggtaagaagccctatgagtgtaaggagtgtggcaaggccttcagttctggctcataccttgttcagcatcaaagaattcatactggggagaaaccctatgaatgtaacaaatgtgggaaagcctttactgtttatggacaacttattggacatcagagtgttcacactggtgagaaaccttttgaatgtaaggaatgcgggaaggcctttagacttaattcattccttactgaacatcagcgggtacacactggtgagaaaccctttaaatgcaaaaaatgtgggaagacctttagatacagttcagcccttaaagtgcatctgagaaaacatatgagtgttataccctaagagtctgaggagtgtgggaagtgcttcgtgtgtggctcaaacattgttgaacatcggggaatttatgctggtaggaaactttcaaatgtgaagaatattggcaggtctattctcatcttataattcataatataactcagaaaacataagaatattcctttgtcatttataggtttgtaataccaatatttatactggtggaccattcagaaaaagtgggaaacgttattacttaatggttacagcactgacagcatgaacttttatatgatgcatttattctaatgtgattgtatgaacaagtgaataaaaaaccttggacctcctaaa

SEQ ID NO: 202081 - DNA, 696 bp, Homo sapiens
  Payload ID: 19863
  Gene Name: zinc finger protein 30
  ENST ID: ENST00000601540
  CDS Start-End: 438-696
actgcgccgggcatgctcggcggtgtgacggctcaggactgcatttcccagaggctgcagctatccggccaatgtagcctgaaactacatttctcagcggccactggaacgacctcaatctctgcctcctcgccagttcattgtggtcgttgacccggcagcgagctttggagttcatcgagggagaagtcagcgcccagctccgaggttggagcagccccgccgggcaacttgaatttctgcaaacgaacacagcaccgggagctctgcagacctgtgtcggcgcggaacccggactgagacatgcgtgagcgttgggtggaccgggcgaggatcccgggccggcgagtgcgggagcggcagggcagggaggcttttgaacttctcagatagaggaaccccagtgaagactgatcagttcttacaattctcaaagcatggcccataaatatgtgggtttgcagtatcacggatcagtgacatttgaggatgtggccatagccttctcccagcaggagtgggagagtctggactcttcccagaggggcttgtacagagatgtgatgttggagaactacaggaacttggtgtcaatggcaggacattcccgttctaaaccacatgtgatcgccttattggaacaatggaaagagcctgaagtgacagtgaggaaagatggaagaagatggtgcacag

SEQ ID NO: 202082 - DNA, 3268 bp, Homo sapiens
  Payload ID: 19864
  Gene Name: zinc finger protein 300
  Uniprot ID: Q96RE9
  ENST ID: ENST00000274599
  CDS Start-End: 422-2236
agtacgaagacgaccgggctctcaagatggcggccccatgcggaaacagctccagggagcagccatgttgcttcctgaacaaagcctctgaagatgcggaacgggcaaaaccgcccagtacggaacggcgcagcctcgggagcccggtgtggtgctcgcggacaggaagcaggagagtttgccaatagggatgtgacagcggttcccattaagcggtgatggtggttttgggacctgataatcgagctgggagtcagaggcgggatgtgtgcggtgaaggatgttttgatacccccatataaaataatctgtctgtcatgggagcccccacgtcctctgaaatagttcagctctgtctgcatgacttgtcctgggactgaggaaaatttaccagtcatctggccttttggaagagcaaaaaatgatgaagtcccaggggttagtatcattcaaggatgtggctgtggatttcacccaggaggagtggcagcaacttgacccttctcagaggaccctgtacagggatgtgatgctggagaactacagccacctggtctcaatggggtatccagtttccaaaccagatgtcatctccaagttggaacaaggagaagagccatggatcataaagggagacatatcaaattggatctatccagatgaatatcaggcagatgggagacaagacaggaagagtaaccttcacaactcccagtcatgtattttggggacagtttccttccatcataagatactgaaaggagtcacaagggatggttcattgtgctccattttaaaagtctgtcaaggtgatggtcagctgcagagatttctagagaatcaagacaaactcttcaggcaggtcacatttgttaacagcaaaacagtgactgaggcatcagggcataaatataatccactggggaaaatatttcaagagtgcatagaaacagatatatcaatacagagattccataaatatgatgcttttaaaaagaacttaaaaccaaatattgacctaccgagttgttataagagcaattcaagaaaaaaacctgatcagagttttggaggtggaaaatcatctagccagagtgagcccaattctaatcttgagaagattcacaatggagtaataccttttgatgataatcagtgtggaaacgtttttagaaatacacaatcccttattcaatatcagaatgtggaaactaaagagaaaagctgtgtatgtgttacatgtggaaaagcctttgctaagaagtcacaactcattgtacatcaaagaattcatactggaaagaaaccatatgattgtggtgcatgcggaaaagccttcagtgagaagtttcatcttgttgtacatcagagaactcatactggggagaaaccttatgattgttctgaatgtggaaaagccttctctcagaaatcgtcccttattatacatcagagagttcacactggggaaaaaccctatgaatgtagtgaatgcgggaaagccttctcccagaaatcacccctcattatacatcagagaatacatactggggaaaaaccctatgaatgtagagagtgtgggaaggccttttcccagaagtcacagctgattatacaccacagagctcatactggagagaagccgtatgagtgtaccgaatgtgggaaagccttctgtgagaagtcccacctcattatacataaaagaattcacactggtgagaaaccctacaaatgtgctcaatgtgaggaagccttcagcaggaagacagaactcattacacatcagttagttcatactggggaaaaaccttatgaatgtactgaatgtggaaagacattctcccgcaagtcacagctcatcatacatcagagaacacatactggagaaaaaccctataaatgtagtgaatgtggcaaagccttctgccagaagtcacatctcattggacatcagagaattcacacaggagaaaaaccttatatatgtactgaatgtgggaaagccttctctcagaagtcccaccttccgggacaccagcgaattcatacaggagagaaaccttacatatgtgctgaatgtggaaaggccttttctcagaagtcagaccttgttttacatcagaggattcatactggggaaagaccctatcaatgtgctatatgtgggaaggccttcatccagaagtcacaactaactgtacaccagagaattcacacagtggtaaaatcataatgaactggccacagaaaagccttagtattagctcaagccttaataattactagaaacccaattaatttgataagcttggggacaacatcccaatagataaaaatttttaagggaatttgtttctagtttggtgatgcctaacttttccagcaaagatgatggaaaatagttatataaatgaagaacatttttaatatggcatgtaaagcttttaaagttatgaactcagtgatcagcacagcaagttaagcatacagaatattgtcaagttgcatattccttatactacaaaatgataatcagccattgtgaaactgctaatattagcttgtcataattatggccataaactaatttttctataaaagacgtggaagaaagcttaagtaaacaataaaataaaacctatacactattttaagaaggggcttgagcatgacccctaaagctacatgtaaagttcttgtacaaaaaatggaatgataggttgatcagattcagtaaagttgatctgtatgcattttcccatctcaagcatataagttgacctgcatctctggaaggaccttgagattgatgcattttgagcaggtctcccttttactcttcccaactgggaacttggagctgaaaaacattggcactgaggccagatggccttgggtttaatcctggctcagtgcctcacagattgtgtgactttaggcaaacatacttctcctagctgagtattttttatcagtaagtacaaatacaatgcagagctcattttcagttaatattagtactttttaaatctttactctctatcttgaagcattagatgttaagactaatgtgtaaaaaccacgtctgagcttgcttttccctctggacactctgcttttgattgcctatccctataagtggctcattttactgtcttctgatcctggtggccttatttttgctatgttaaggttgtgttttttaatacttggatttattttcatatacttacataaaccgtggtgattgcacataaagaccctg

SEQ ID NO: 202083 - DNA, 3256 bp, Homo sapiens
  Payload ID: 19864
  Gene Name: zinc finger protein 300
  ENST ID: ENST00000394226
  CDS Start-End: 417-2231
gaagacgaccgggctctcaagatggcggccccatgcggaaacagctccagggagcagccatgttgcttcctgaacaaagcctctgaagatgcggaacgggcaaaaccgcccagtacggaacggcgcagcctcgggagcccggtgtggtgctcgcggacaggaagcaggagagtttgccaatagggatgtgacagcggttcccattaagcggtgatggtggttttgggacctgataatcgagctgggagtcagaggcgggatgtgtgcggtgaaggatgttttgatacccccatataaaataatctgtctgtcatgggagcccccacgtcctctgaaatagttcagctctgtctgcatgacttgtcctgggactgaggaaaatttaccagtcatctggccttttggaagagcaaaaaatgatgaagtcccaggggttagtatcattcaaggatgtggctgtggatttcacccaggaggagtggcagcaacttgacccttctcagaggaccctgtacagggatgtgatgctggagaactacagccacctggtctcaatggggtatccagtttccaaaccagatgtcatctccaagttggaacaaggagaagagccatggatcataaagggagacatatcaaattggatctatccagatgaatatcaggcagatgggagacaagggaagaagagtaaccttcacaactcccagtcatgtattttggggacagtttccttccatcataagatactgaaaggagtcacaagggatggttcattgtgctccattttaaaagtctgtcaaggtgatggtcagctgcagagatttctagagaatcaagacaaactcttcaggcaggtcacatttgttaacagcaaaacagtgactgaggcatcagggcataaatataatccactggggaaaatatttcaagagtgcatagaaacagatatatcaatacagagattccataaatatgatgcttttaaaaagaacttaaaaccaaatattgacctaccgagttgttataagagcaattcaagaaaaaaacctgatcagagttttggaggtggaaaatcatctagccagagtgagcccaattctaatcttgagaagattcacaatggagtaataccttttgatgataatcagtgtggaaacgtttttagaaatacacaatcccttattcaatatcagaatgtggaaactaaagagaaaagctgtgtatgtgttacatgtggaaaagcctttgctaagaagtcacaactcattgtacatcaaagaattcatactggaaagaaaccatatgattgtggtgcatgcggaaaagccttcagtgagaagtttcatcttgttgtacatcagagaactcatactggggagaaaccttatgattgttctgaatgtggaaaagccttctctcagaaatcgtcccttattatacatcagagagttcacactggggaaaaaccctatgaatgtagtgaatgcgggaaagccttctcccagaaatcacccctcattatacatcagagaatacatactggggaaaaaccctatgaatgtagagagtgtgggaaggccttttcccagaagtcacagctgattatacaccacagagctcatactggagagaagccgtatgagtgtaccgaatgtgggaaagccttctgtgagaagtcccacctcattatacataaaagaattcacactggtgagaaaccctacaaatgtgctcaatgtgaggaagccttcagcaggaagacagaactcattacacatcagttagttcatactggggaaaaaccttatgaatgtactgaatgtggaaagacattctcccgcaagtcacagctcatcatacatcagagaacacatactggagaaaaaccctataaatgtagtgaatgtggcaaagccttctgccagaagtcacatctcattggacatcagagaattcacacaggagaaaaaccttatatatgtactgaatgtgggaaagccttctctcagaagtcccaccttccgggacaccagcgaattcatacaggagagaaaccttacatatgtgctgaatgtggaaaggccttttctcagaagtcagaccttgttttacatcagaggattcatactggggaaagaccctatcaatgtgctatatgtgggaaggccttcatccagaagtcacaactaactgtacaccagagaattcacacagtggtaaaatcataatgaactggccacagaaaagccttagtattagctcaagccttaataattactagaaacccaattaatttgataagcttggggacaacatcccaatagataaaaatttttaagggaatttgtttctagtttggtgatgcctaacttttccagcaaagatgatggaaaatagttatataaatgaagaacatttttaatatggcatgtaaagcttttaaagttatgaactcagtgatcagcacagcaagttaagcatacagaatattgtcaagttgcatattccttatactacaaaatgataatcagccattgtgaaactgctaatattagcttgtcataattatggccataaactaatttttctataaaagacgtggaagaaagcttaagtaaacaataaaataaaacctatacactattttaagaaggggcttgagcatgacccctaaagctacatgtaaagttcttgtacaaaaaatggaatgataggttgatcagattcagtaaagttgatctgtatgcattttcccatctcaagcatataagttgacctgcatctctggaaggaccttgagattgatgcattttgagcaggtctcccttttactcttcccaactgggaacttggagctgaaaaacattggcactgaggccagatggccttgggtttaatcctggctcagtgcctcacagattgtgtgactttaggcaaacatacttctcctagctgagtattttttatcagtaagtacaaatacaatgcagagctcattttcagttaatattagtactttttaaatctttactctctatcttgaagcattagatgttaagactaatgtgtaaaaaccacgtctgagcttgcttttccctctggacactctgcttttgattgcctatccctataagtggctcattttactgtcttctgatcctggtggccttatttttgctatgttaaggttgtgttttttaatacttggatttattttcatatacttacataaaccgtggtgattgcacataaa

SEQ ID NO: 202084 - DNA, 3226 bp, Homo sapiens
  Payload ID: 19864
  Gene Name: zinc finger protein 300
  Uniprot ID: Q96RE9
  ENST ID: ENST00000418587
  CDS Start-End: 488-2194
agtacgaagacgaccgggctctcaagatggcggccccatgcggaaacagctccagggagcagccatgttgcttcctgaacaaagcctctgaagatgcggaacgggcaaaaccgcccagtacggaacggcgcagcctcgggagcccggtgtggtgctcgcggacaggaagcaggagagtttgccaatagggatgtgacagcggttcccattaagcggtgatggtggttttgggacctgataatcgagctgggagtcagaggcgggatgtgtgcggtgaaggatgttttgatacccccatataaaataatctgtctgtcatgggagcccccacgtcctctgaaatagttcagctctgtctgcatgacttgtcctgggactgaggaaaatttaccaggggttagtatcattcaaggatgtggctgtggatttcacccaggaggagtggcagcaacttgacccttctcagaggaccctgtacagggatgtgatgctggagaactacagccacctggtctcaatggggtatccagtttccaaaccagatgtcatctccaagttggaacaaggagaagagccatggatcataaagggagacatatcaaattggatctatccagatgaatatcaggcagatgggagacaagacaggaagagtaaccttcacaactcccagtcatgtattttggggacagtttccttccatcataagatactgaaaggagtcacaagggatggttcattgtgctccattttaaaagtctgtcaaggtgatggtcagctgcagagatttctagagaatcaagacaaactcttcaggcaggtcacatttgttaacagcaaaacagtgactgaggcatcagggcataaatataatccactggggaaaatatttcaagagtgcatagaaacagatatatcaatacagagattccataaatatgatgcttttaaaaagaacttaaaaccaaatattgacctaccgagttgttataagagcaattcaagaaaaaaacctgatcagagttttggaggtggaaaatcatctagccagagtgagcccaattctaatcttgagaagattcacaatggagtaataccttttgatgataatcagtgtggaaacgtttttagaaatacacaatcccttattcaatatcagaatgtggaaactaaagagaaaagctgtgtatgtgttacatgtggaaaagcctttgctaagaagtcacaactcattgtacatcaaagaattcatactggaaagaaaccatatgattgtggtgcatgcggaaaagccttcagtgagaagtttcatcttgttgtacatcagagaactcatactggggagaaaccttatgattgttctgaatgtggaaaagccttctctcagaaatcgtcccttattatacatcagagagttcacactggggaaaaaccctatgaatgtagtgaatgcgggaaagccttctcccagaaatcacccctcattatacatcagagaatacatactggggaaaaaccctatgaatgtagagagtgtgggaaggccttttcccagaagtcacagctgattatacaccacagagctcatactggagagaagccgtatgagtgtaccgaatgtgggaaagccttctgtgagaagtcccacctcattatacataaaagaattcacactggtgagaaaccctacaaatgtgctcaatgtgaggaagccttcagcaggaagacagaactcattacacatcagttagttcatactggggaaaaaccttatgaatgtactgaatgtggaaagacattctcccgcaagtcacagctcatcatacatcagagaacacatactggagaaaaaccctataaatgtagtgaatgtggcaaagccttctgccagaagtcacatctcattggacatcagagaattcacacaggagaaaaaccttatatatgtactgaatgtgggaaagccttctctcagaagtcccaccttccgggacaccagcgaattcatacaggagagaaaccttacatatgtgctgaatgtggaaaggccttttctcagaagtcagaccttgttttacatcagaggattcatactggggaaagaccctatcaatgtgctatatgtgggaaggccttcatccagaagtcacaactaactgtacaccagagaattcacacagtggtaaaatcataatgaactggccacagaaaagccttagtattagctcaagccttaataattactagaaacccaattaatttgataagcttggggacaacatcccaatagataaaaatttttaagggaatttgtttctagtttggtgatgcctaacttttccagcaaagatgatggaaaatagttatataaatgaagaacatttttaatatggcatgtaaagcttttaaagttatgaactcagtgatcagcacagcaagttaagcatacagaatattgtcaagttgcatattccttatactacaaaatgataatcagccattgtgaaactgctaatattagcttgtcataattatggccataaactaatttttctataaaagacgtggaagaaagcttaagtaaacaataaaataaaacctatacactattttaagaaggggcttgagcatgacccctaaagctacatgtaaagttcttgtacaaaaaatggaatgataggttgatcagattcagtaaagttgatctgtatgcattttcccatctcaagcatataagttgacctgcatctctggaaggaccttgagattgatgcattttgagcaggtctcccttttactcttcccaactgggaacttggagctgaaaaacattggcactgaggccagatggccttgggtttaatcctggctcagtgcctcacagattgtgtgactttaggcaaacatacttctcctagctgagtattttttatcagtaagtacaaatacaatgcagagctcattttcagttaatattagtactttttaaatctttactctctatcttgaagcattagatgttaagactaatgtgtaaaaaccacgtctgagcttgcttttccctctggacactctgcttttgattgcctatccctataagtggctcattttactgtcttctgatcctggtggccttatttttgctatgttaaggttgtgttttttaatacttggatttattttcatatacttacataaaccgtggtgattgcacataaagaccctg

SEQ ID NO: 202085 - DNA, 3323 bp, Homo sapiens
  Payload ID: 19864
  Gene Name: zinc finger protein 300
  Uniprot ID: Q96RE9
  ENST ID: ENST00000446148
  CDS Start-End: 429-2291
agtacgaagacgaccgggctctcaagatggcggccccatgcggaaacagctccagggagcagccatgttgcttcctgaacaaagcctctgaagatgcggaacgggcaaaaccgcccagtacggaacggcgcagcctcgggagcccggtgtggtgctcgcggacaggaagcaggagagtttgccaatagggatgtgacagcggttcccattaagcggtgatggtggttttgggacctgataatcgagctgggagtcagaggcgggatgtgtgcggtgaaggatgttttgatacccccatataaaataatctgtctgtcatgggagcccccacgtcctctgaaatagttcagctctgtctgcatgacttgtcctgggactgaggaaaatttaccaggtacaagaggagtaaagaatgatccctcctccacatggtgcctgctgagacttcttcatctggccttttggaagagcaaaaaatgatgaagtcccaggggttagtatcattcaaggatgtggctgtggatttcacccaggaggagtggcagcaacttgacccttctcagaggaccctgtacagggatgtgatgctggagaactacagccacctggtctcaatggggtatccagtttccaaaccagatgtcatctccaagttggaacaaggagaagagccatggatcataaagggagacatatcaaattggatctatccagatgaatatcaggcagatgggagacaagacaggaagagtaaccttcacaactcccagtcatgtattttggggacagtttccttccatcataagatactgaaaggagtcacaagggatggttcattgtgctccattttaaaagtctgtcaaggtgatggtcagctgcagagatttctagagaatcaagacaaactcttcaggcaggtcacatttgttaacagcaaaacagtgactgaggcatcagggcataaatataatccactggggaaaatatttcaagagtgcatagaaacagatatatcaatacagagattccataaatatgatgcttttaaaaagaacttaaaaccaaatattgacctaccgagttgttataagagcaattcaagaaaaaaacctgatcagagttttggaggtggaaaatcatctagccagagtgagcccaattctaatcttgagaagattcacaatggagtaataccttttgatgataatcagtgtggaaacgtttttagaaatacacaatcccttattcaatatcagaatgtggaaactaaagagaaaagctgtgtatgtgttacatgtggaaaagcctttgctaagaagtcacaactcattgtacatcaaagaattcatactggaaagaaaccatatgattgtggtgcatgcggaaaagccttcagtgagaagtttcatcttgttgtacatcagagaactcatactggggagaaaccttatgattgttctgaatgtggaaaagccttctctcagaaatcgtcccttattatacatcagagagttcacactggggaaaaaccctatgaatgtagtgaatgcgggaaagccttctcccagaaatcacccctcattatacatcagagaatacatactggggaaaaaccctatgaatgtagagagtgtgggaaggccttttcccagaagtcacagctgattatacaccacagagctcatactggagagaagccgtatgagtgtaccgaatgtgggaaagccttctgtgagaagtcccacctcattatacataaaagaattcacactggtgagaaaccctacaaatgtgctcaatgtgaggaagccttcagcaggaagacagaactcattacacatcagttagttcatactggggaaaaaccttatgaatgtactgaatgtggaaagacattctcccgcaagtcacagctcatcatacatcagagaacacatactggagaaaaaccctataaatgtagtgaatgtggcaaagccttctgccagaagtcacatctcattggacatcagagaattcacacaggagaaaaaccttatatatgtactgaatgtgggaaagccttctctcagaagtcccaccttccgggacaccagcgaattcatacaggagagaaaccttacatatgtgctgaatgtggaaaggccttttctcagaagtcagaccttgttttacatcagaggattcatactggggaaagaccctatcaatgtgctatatgtgggaaggccttcatccagaagtcacaactaactgtacaccagagaattcacacagtggtaaaatcataatgaactggccacagaaaagccttagtattagctcaagccttaataattactagaaacccaattaatttgataagcttggggacaacatcccaatagataaaaatttttaagggaatttgtttctagtttggtgatgcctaacttttccagcaaagatgatggaaaatagttatataaatgaagaacatttttaatatggcatgtaaagcttttaaagttatgaactcagtgatcagcacagcaagttaagcatacagaatattgtcaagttgcatattccttatactacaaaatgataatcagccattgtgaaactgctaatattagcttgtcataattatggccataaactaatttttctataaaagacgtggaagaaagcttaagtaaacaataaaataaaacctatacactattttaagaaggggcttgagcatgacccctaaagctacatgtaaagttcttgtacaaaaaatggaatgataggttgatcagattcagtaaagttgatctgtatgcattttcccatctcaagcatataagttgacctgcatctctggaaggaccttgagattgatgcattttgagcaggtctcccttttactcttcccaactgggaacttggagctgaaaaacattggcactgaggccagatggccttgggtttaatcctggctcagtgcctcacagattgtgtgactttaggcaaacatacttctcctagctgagtattttttatcagtaagtacaaatacaatgcagagctcattttcagttaatattagtactttttaaatctttactctctatcttgaagcattagatgttaagactaatgtgtaaaaaccacgtctgagcttgcttttccctctggacactctgcttttgattgcctatccctataagtggctcattttactgtcttctgatcctggtggccttatttttgctatgttaaggttgtgttttttaatacttggatttattttcatatacttacataaaccgtggtgattgcacataaagaccctg

SEQ ID NO: 202086 - DNA, 4155 bp, Homo sapiens
  Payload ID: 19864
  Gene Name: zinc finger protein 300
  ENST ID: ENST00000427179
  CDS Start-End: 228-500
gacagcggttcccattaagcggtgatggtggttttgggacctgataatcgagctgggagtcagaggcgggatgtgtgcggtgaaggatgttttgatacccccatataaaataatctgtctgtcatgggagcccccacgtcctctgaaatagttcagctctgtctgcatgacttgtcctgggactgaggaaaatttaccagtcatctggccttttggaagagcaaaaaatgatgaagtcccaggggttagtatcattcaaggatgtggctgtggatttcacccaggaggagtggcagcaacttgacccttctcagaggaccctgtacagggatgtgatgctggagaactacagccacctggtctcaatggggtatccagtttccaaaccagatgtcatctccaagttggaacaaggagaagagccatggatcataaagggagacatatcaaattggatctatccagatgaatatcaggcagatgggagacaagggaagtgaaatatcaatttatgtttttttaattgattggtgcctgaggtttatgtttctatccttatcaaaatctcctattctttgcttctatgctgagaatttagtagtcactcaacaagtaattgtgaagcctttcagaggagttctatttgttgttgatcctgtctcttgtgtgtatatatatatgtttatatttgttgtctttcctgaaagggttttaaaggcaatagaaggcaaattcctttcaagaacacaagctgtgctttaaaaggcaatattcccagataaatgactgtattaaattaaatgtcaaatacagttactgttttagaagttcagagaaaattaagagtctaaagagatgtgagcgtatttgagaaacatttttcagagcatgcaactgtaactgctctgaatgacataaatgctgatgaggctgaaggaggagggtgaaggcaagcagtgttggagagagagtatatgaacaaaaccttagggtcaggaagatacagcttttctgggagaactttactagttttacttgacatgtatagaaagtagtttattgggagtagtggaatttacgtctgtattctcagtttgactctgatactgaatctgtagcaggatattggatttttctattatttgttagttgttaggaaaatagatggaggagagttaaagtattttgcatacagaagataccttgttttttagagtgatggtaggataataagaatgtgtagcacatgatttataatataaatgaaattaaaaggtgaaaaggggtttctattcagaaagcagaagtgaaatattctagaagaataatcaaaaattagtgatgagaccccactttttcatctcttttaagtttagtttttacatgaatatttctgtttaacattcttgtctgtctattcacctgataacactatatgctgtactgtcttctgagatgacctgtttccatcctttttttgtgagttcatctactatgttggatcatccatttgttctacttctttaccctcttaattgactcttgtgatgactcttaaattgtatcttttcttcttttagacaggaagagtaaccttcacaactcccagtcatgtattttggggacagtttccttccatcataagatactgaaaggagtcacaagggatggttcattgtgctccattttaaaagtctgtcaaggtgatggtcagctgcagagatttctagagaatcaagacaaactcttcaggcaggtcacatttgttaacagcaaaacagtgactgaggcatcagggcataaatataatccactggggaaaatatttcaagagtgcatagaaacagatatatcaatacagagattccataaatatgatgcttttaaaaagaacttaaaaccaaatattgacctaccgagttgttataagagcaattcaagaaaaaaacctgatcagagttttggaggtggaaaatcatctagccagagtgagcccaattctaatcttgagaagattcacaatggagtaataccttttgatgataatcagtgtggaaacgtttttagaaatacacaatcccttattcaatatcagaatgtggaaactaaagagaaaagctgtgtatgtgttacatgtggaaaagcctttgctaagaagtcacaactcattgtacatcaaagaattcatactggaaagaaaccatatgattgtggtgcatgcggaaaagccttcagtgagaagtttcatcttgttgtacatcagagaactcatactggggagaaaccttatgattgttctgaatgtggaaaagccttctctcagaaatcgtcccttattatacatcagagagttcacactggggaaaaaccctatgaatgtagtgaatgcgggaaagccttctcccagaaatcacccctcattatacatcagagaatacatactggggaaaaaccctatgaatgtagagagtgtgggaaggccttttcccagaagtcacagctgattatacaccacagagctcatactggagagaagccgtatgagtgtaccgaatgtgggaaagccttctgtgagaagtcccacctcattatacataaaagaattcacactggtgagaaaccctacaaatgtgctcaatgtgaggaagccttcagcaggaagacagaactcattacacatcagttagttcatactggggaaaaaccttatgaatgtactgaatgtggaaagacattctcccgcaagtcacagctcatcatacatcagagaacacatactggagaaaaaccctataaatgtagtgaatgtggcaaagccttctgccagaagtcacatctcattggacatcagagaattcacacaggagaaaaaccttatatatgtactgaatgtgggaaagccttctctcagaagtcccaccttccgggacaccagcgaattcatacaggagagaaaccttacatatgtgctgaatgtggaaaggccttttctcagaagtcagaccttgttttacatcagaggattcatactggggaaagaccctatcaatgtgctatatgtgggaaggccttcatccagaagtcacaactaactgtacaccagagaattcacacagtggtaaaatcataatgaactggccacagaaaagccttagtattagctcaagccttaataattactagaaacccaattaatttgataagcttggggacaacatcccaatagataaaaatttttaagggaatttgtttctagtttggtgatgcctaacttttccagcaaagatgatggaaaatagttatataaatgaagaacatttttaatatggcatgtaaagcttttaaagttatgaactcagtgatcagcacagcaagttaagcatacagaatattgtcaagttgcatattccttatactacaaaatgataatcagccattgtgaaactgctaatattagcttgtcataattatggccataaactaatttttctataaaagacgtggaagaaagcttaagtaaacaataaaataaaacctatacactattttaagaaggggcttgagcatgacccctaaagctacatgtaaagttcttgtacaaaaaatggaatgataggttgatcagattcagtaaagttgatctgtatgcattttcccatctcaagcatataagttgacctgcatctctggaaggaccttgagattgatgcattttgagcaggtctcccttttactcttcccaactgggaacttggagctgaaaaacattggcactgaggccagatggccttgggtttaatcctggctcagtgcctcacagattgtgtgactttaggcaaacatacttctcctagctgagtattttttatcagtaagtacaaatacaatgcagagctcattttcagttaatattagtactttttaaatctttactctctatcttgaagcattagatgttaagactaatgtgtaaaaaccacgtctgagcttgcttttccctctggacactctgcttttgattgcctatccctataagtggctcattttactgtcttctgatcctggtggccttatttttgctatgttaaggttgtgttttttaatacttggatttattttcatatacttacataaaccgtggtgattgcacataaa

SEQ ID NO: 202087 - DNA, 2600 bp, Homo sapiens
  Payload ID: 19865
  Gene Name: zinc finger protein 302
  Uniprot ID: Q9NR11
  ENST ID: ENST00000457781
  CDS Start-End: 241-1440
gtgggcggtgcactgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatcatgaac

SEQ ID NO: 202088 - DNA, 2635 bp, Homo sapiens
  Payload ID: 19865
  Gene Name: zinc finger protein 302
  ENST ID: ENST00000446502
  CDS Start-End: 209-1540
aagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggacactgcccatctctaagataagaacctggaaaggggactctgttggccattggaaattgcagaataatgtctcagcgtcagtacccagagtgttacctggcaccaaatggatgcttagtaagtaattgtggagtgaataagatgagtaatgaagaactggtggggcagaatcatggcatggaaggtgaagcttgcacaggaggggatgtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgc

SEQ ID NO: 202089 - DNA, 2590 bp, Homo sapiens
  Payload ID: 19865
  Gene Name: zinc finger protein 302
  Uniprot ID: Q9NR11
  ENST ID: ENST00000423823
  CDS Start-End: 237-1436
gatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatc

SEQ ID NO: 202090 - DNA, 2849 bp, Homo sapiens
  Payload ID: 19865
  Gene Name: zinc finger protein 302
  Uniprot ID: Q9NR11
  ENST ID: ENST00000505242
  CDS Start-End: 495-1694
gtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggcaagtgtgggtcgcggcgacggcggggctaaggccctgggtccgcgcgcggtttgaccacggccggggccttgggcatttcctggccttcctgttgagccgtgtaaacgcggggtgatgacggcgccgacctcttggcactgttgtgagagcgaagtgggcgcgagagcagacgccagctacagttttttttgggttatgtcgtcatgaagccggcgctttcagttgtgcaaccttgaacaaatgggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatca

SEQ ID NO: 202091 - DNA, 854 bp, Homo sapiens
  Payload ID: 19865
  Gene Name: zinc finger protein 302
  ENST ID: ENST00000507959
  CDS Start-End: 224-622
ctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtagcaggtctttccgtaactaagccatatgtgatcatgttattggaggatggaaaagagccctggatgatggagaaaaaactgtcaaaagcttacccatttcctttatcacactctgttcctgcttctgtgaactttggattctctgctctatttgagcattgttcagaagtcactgaaatatttgagttgtcagaactatgtgttttctgggtgcttcatttcttatccaattctcctaattccactgtagaagcttttttcaagaagtaaaaaaaaaaaaaaaaaaaaaaaaaaaaaaaaaaaaaaaaaaaaaaaaaggcagtgctttgctttcttgatatatttcagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacac

SEQ ID NO: 202092 - DNA, 572 bp, Homo sapiens
  Payload ID: 19865
  Gene Name: zinc finger protein 302
  ENST ID: ENST00000505163
  CDS Start-End: 146-572
gtcagtcccgcgatagcttcaggcctggcggcggcttccaagctaaggaacggtttggggcagtgtcgttcccggaggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctg

SEQ ID NO: 202093 - DNA, 2955 bp, Homo sapiens
  Payload ID: 19865
  Gene Name: zinc finger protein 302
  ENST ID: ENST00000505365
  CDS Start-End: 337-732
gaggccctgctgaggactccggcaagtgtgggtcgcggcgacggcggggctaaggccctgggtccgcgcgcggtttgaccacggccggggccttgggcatttcctggccttcctgttgagccgtgtaaacgcggggtgatgacggcgccgacctcttggcactgttgtgagagcgaagtgggcgcgagagcagacgccagctacagttttttttgggttatgtcgtcatgaagccggcgctttcagttgtgcaaccttgaacaaatgggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagcttacccatttcctttatcacactctgttcctgcttctgtgaactttggattctctgctctatttgagcattgttcagaagtcactgaaatatttgagttgtcagaactatgtgttttctgggtgcttcatttcttatccaattctcctaattccactgtagaagcttttttcaagaagtaaaaaaaaaaaaaaaaaaaaaaaaaaaaaaaaaaaaaaaaaaaaaaaaaggcagtgctttgctttcttgatatatttcagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatcatgaa

SEQ ID NO: 202094 - DNA, 578 bp, Homo sapiens
  Payload ID: 19865
  Gene Name: zinc finger protein 302
  ENST ID: ENST00000502743
  CDS Start-End: 219-578
gaaatgtggttcgccgtgggcggtgcactgggtcagtcccgcgatagcttcaggcctggcggcggcttccaagctaaggaacggtttggggcagtgtcgttcccggaggtcggccgccgttacccgctcaccagctacgcggcgcgtcaggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagcttacccatttcctttatcacactctgttcctgcttctgtgaactttggattctctgctctatttgagcattgttcagaagtcactgaaatatttgagttgtcagaactatgtgttttctgggtgcttcatttcttatccaattct

SEQ ID NO: 202095 - DNA, 675 bp, Homo sapiens
  Payload ID: 19865
  Gene Name: zinc finger protein 302
  ENST ID: ENST00000506901
  CDS Start-End: 278-675
ggttcgccgtgggcggtgcactgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggcaagtgacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtagcaggtctttccgtaactaagccatatgtgatcatgttattggaggatggaaaagagccctggatgatggagaaaaaactgtcaaaagcttacccatttcctttatcacactctgttcctgcttctgtgaactttggattctctgctctatttgagcattgttcagaagtcactgaaatatttgagttgtcagaactatgtgttttctgggtgcttcatttcttatccaattctcctaattccactgtagaagcttttttcaagaagta

SEQ ID NO: 202096 - DNA, 577 bp, Homo sapiens
  Payload ID: 19865
  Gene Name: zinc finger protein 302
  ENST ID: ENST00000509528
  CDS Start-End: 279-365
gaaatgtggttcgccgtgggcggtgcactgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggacactgcccatctctaagataagaacctggaaaggggactctgttggccattggaaattgcagaataatgtctcagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaat

SEQ ID NO: 202097 - DNA, 2893 bp, Homo sapiens
  Payload ID: 19865
  Gene Name: zinc finger protein 302
  ENST ID: ENST00000613363
  CDS Start-End: 534-1736
gattctgggaaatgtggttcgccgtgggcggtgcactgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggcaagtgtgggtcgcggcgacggcggggctaaggccctgggtccgcgcgcggtttgaccacggccggggccttgggcatttcctggccttcctgttgagccgtgtaaacgcggggtgatgacggcgccgacctcttggcactgttgtgagagcgaagtgggcgcgagagcagacgccagctacagttttttttgggttatgtcgtcatgaagccggcgctttcagttgtgcaaccttgaacaaatgggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtagcaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatcatg

SEQ ID NO: 202098 - DNA, 1723 bp, Homo sapiens
  Payload ID: 19865
  Gene Name: zinc finger protein 302
  ENST ID: ENST00000627982
  CDS Start-End: 287-1723
gattctgggaaatgtggttcgccgtgggcggtgcactgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtagcaggtctttccgtaactaagccatatgtgatcatgttattggaggatggaaaagagccctggatgatggagaaaaaactgtcaaaagcttacccatttcctttatcacactctgttcctgcttctgtgaactttggattctctgctctatttgagcattgttcagaagtcactgaaatatttgagttgtcagaactatgtgttttctgggtgcttcatttcttatccaattctcctaattccactgtagaagcttttttcaagaaaaaaaaaaaaaaaaaaaaaaaaaaaaaaaggcagtgctttgctttcttgatatatttcagattgggaatcaagatgggaaaacaaggaattatcaacaaagaaggatatttagaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttag

SEQ ID NO: 202099 - DNA, 4202 bp, Homo sapiens
  Payload ID: 19866
  Gene Name: zinc finger protein 304
  Uniprot ID: Q9HCX3
  ENST ID: ENST00000282286
  CDS Start-End: 174-2153
acacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcagagttgtgtgaccttcgaggatgtgttcgtgtacttctctcgggaggagtgggaactccttgaggaggcacagagattcctgtaccgtgatgtgatgctggagaactttgcacttgtggctacactaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcgaaaatctcctgtgcttgtggaagcaacataagttgggtcccttaactgtcacgtactccccagcactgttgagggattgctgtcttctgtacctgtacaggatcaagtccctgatatccagaaccccataggcaagtaacattgactgtaagacctctgtagggcaatgtgaaaatcatgattgctacagaagcactgagataatggagtggggatgactgtggcaaacaaaaggagattcgaacattctagaggggcatccacaagtctcggtgcagttatgatggtgtgggatgggagtgcatagaaattctcaggaccttcagacatctgtatctcctgtggccaaggccactgtcagaggaaataatctaaatgtttgtggattcctgtgtctccctgggcagttgacctgcacagacaggaacctcagcagtgacagaagagagatccagggatgggtcttctctgacccagccagcattccgagtgactgaggtggatgtggacatcattgcttaccaatttttaccaacattgaggcagggctcactctcctaaattgtagggagaggaatatggtaaagccaaaatagttgacagatctaactttcctagtggaacagtatatatagattttaatgaggaacatttatttaatagctttatggaggtatgattaacatgcaataaactgcaaatatgtaaagtgtaaaatgtgctgtttcagcatgtgtgtacacctatgaaaccaccacagtcaagatatccaacacaacaaaagattgtccctttataatcctcaatttttccttatcttgttttccacaattcacaagcaacagcaagcattttctataattttataaatgaaaccatatggtgtgtactttttagggggtggggctctggctttttcagtaaacataactattttaaggttaatccattatcttgttgcatgaatcaattgtttgctcatttgtattgctgcgtagtatttcagtatttcattgtataccacaatttttcttctttgtcaacttaattgttatggatgtttgggtaactttcagtttttggctattacaaataaacctctgaagatttgtgtgcaaa

SEQ ID NO: 202100 - DNA, 4313 bp, Homo sapiens
  Payload ID: 19866
  Gene Name: zinc finger protein 304
  Uniprot ID: Q9HCX3
  ENST ID: ENST00000391705
  CDS Start-End: 285-2264
tgaaggctgagttctagagatcgggtcggctttctacgcggctctcgtggaacctagcaaagaaagacagtgaagactgcaggaccttccttcgcgcttttgttacaatccacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcagagttgtgtgaccttcgaggatgtgttcgtgtacttctctcgggaggagtgggaactccttgaggaggcacagagattcctgtaccgtgatgtgatgctggagaactttgcacttgtggctacactaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcgaaaatctcctgtgcttgtggaagcaacataagttgggtcccttaactgtcacgtactccccagcactgttgagggattgctgtcttctgtacctgtacaggatcaagtccctgatatccagaaccccataggcaagtaacattgactgtaagacctctgtagggcaatgtgaaaatcatgattgctacagaagcactgagataatggagtggggatgactgtggcaaacaaaaggagattcgaacattctagaggggcatccacaagtctcggtgcagttatgatggtgtgggatgggagtgcatagaaattctcaggaccttcagacatctgtatctcctgtggccaaggccactgtcagaggaaataatctaaatgtttgtggattcctgtgtctccctgggcagttgacctgcacagacaggaacctcagcagtgacagaagagagatccagggatgggtcttctctgacccagccagcattccgagtgactgaggtggatgtggacatcattgcttaccaatttttaccaacattgaggcagggctcactctcctaaattgtagggagaggaatatggtaaagccaaaatagttgacagatctaactttcctagtggaacagtatatatagattttaatgaggaacatttatttaatagctttatggaggtatgattaacatgcaataaactgcaaatatgtaaagtgtaaaatgtgctgtttcagcatgtgtgtacacctatgaaaccaccacagtcaagatatccaacacaacaaaagattgtccctttataatcctcaatttttccttatcttgttttccacaattcacaagcaacagcaagcattttctataattttataaatgaaaccatatggtgtgtactttttagggggtggggctctggctttttcagtaaacataactattttaaggttaatccattatcttgttgcatgaatcaattgtttgctcatttgtattgctgcgtagtatttcagtatttcattgtataccacaatttttcttctttgtcaacttaattgttatggatgtttgggtaactttcagtttttggctattacaaataaacctctgaagatttgtgtgcaaa

SEQ ID NO: 202101 - DNA, 3391 bp, Homo sapiens
  Payload ID: 19866
  Gene Name: zinc finger protein 304
  ENST ID: ENST00000443917
  CDS Start-End: 340-2460
atcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcagagttgtgtgaccttcgaggatgtgttcgtgtacttctctcgggaggagtgggaactccttgaggaggcacagagattcctgtaccgtgatgtgatgctggagaactttgcacttgtggctacactagctttcattttcccagtcccatgcagttgcgcagttggagggggcagaaaaccttgggtgcctgacagggcagacatcactgcagccacagtaaaggagacctacagagggcatggccctgctgaatgggagctggaagagggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcga

SEQ ID NO: 202102 - DNA, 3331 bp, Homo sapiens
  Payload ID: 19866
  Gene Name: zinc finger protein 304
  ENST ID: ENST00000598744
  CDS Start-End: 547-2400
atcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcaggttgagaacagactgtgagcatgagggagcagctactgcagtagtgttgatggtgtctggtctagaggtgtggctgtggagagttgtgtgaccttcgaggatgtgttcgtgtacttctctcgggaggagtgggaactccttgaggaggcacagagattcctgtaccgtgatgtgatgctggagaactttgcacttgtggctacactaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcga

SEQ ID NO: 202103 - DNA, 2730 bp, Homo sapiens
  Payload ID: 19867
  Gene Name: zinc finger protein 311
  Uniprot ID: Q5JNZ3
  ENST ID: ENST00000377179
  CDS Start-End: 514-2514
agcatccattcatatattcattcagtcagctaatttttaatccagcacatactattgcaagcgctgttttaggcgttgagaatacaactgtgaacaagacgacaaaaattcctgccctcatggagcctaagagcctagattttagcgaaggtagaaccaccgtaaacaatgtatatattaataagtaacttatgcaccatactggaaaattataaagtgctatagaggaaaagaagaattcatgtaaagcaagggaaacaagatgtgagatcacagcggtttagtgttgctaatgaaccccaaatccagggcagtgtttgacacattaagccaaacagtagcggcactgtgggtcaagaagggccctttggctggcaccaccaaaacatgtgttctccaaaggaggctggcatcaactggagccacttcacagcttgtttgagaactggatctgaccagtaggaagaaaccaggacagcagtggaagactgttaaagaaacctgagtaaaaagatgcaggaggttgtgctgttggatgagagttcaggaccaccaagccagctgctttggacccgccaggatacccagctccctcaggaaagcgctctattacctgctccatatcctgccttcactaaagatggaagccaaggaaacctgccgcaagcagatatcacactaatgagccaggcccaagagtcagtgacatttgaggatgtagctgtgaacttcactaacagggagtggcagtgtctgacctacgctcaaaggcatctctataaggatgtgatgttggaaaattatgggaacatggtatcacttggatttccatttcctaaacctcctttaatctctcatctggagcgagaagtagacccctgtgtgcaggatccacaggacagggagtccctaagctgctcctacccagtgtcagctgacaagatgtggcctgagaatgaaaaggcaagttcacaacaagagatttttgaaaatggagaagcctactggatgaaatttaacagtctcctaaaagttgattcccgggatcctaaggttagagaagtttgtgttcaggatgtcaaattagagaatcaatgggaaacatctataagggagaaactgagagaagagaaagaaggctctgaggaagtgacctgcaaaaaaggaaagaaccagaaagtgcttagtaaaaacttgaatccaaactcaaaacatagtcaatgtaataaagttcttatagcacagaaactccatgaatgtgccaggtgtggcaaaaacttcagttggcactcagatctaattctccatgagcaaattcattctggtgagaaaccccatgtgtgtaatgagtgtgggaaagcattcaagaccagaaatcagctttctatgcaccggataatccacacaggggagaaaccttttaattgcacccagtgtgggaaggctttcaacagtagatcagctctttgccgacataaaaaaacccacagtggggagaagcctcacgagtgcagggactgtgggaaggccttcaagaccaggaaccgtctctgtatgcatcagcttatccacaccggggagaagccttacaaatgtaactgctgtgggaaggccttccagtttaagcattcccttaccatccatggcagaatccacactggggagaagccatatgaatgtgaggagtgcgggaaggccttcagtgggagttcagacctcaccaaacacataagaatccacactggggaacgaccttatgagtgcagcaagtgtggaagggccttcagtcggagctcagacctaagcaaacacaaacgaatccatactcgggagaaacactatgggtgtccccagtgtggaaaagacttcagcatcaaggcagaactcaccaaacacagaaggatccacactgaagagaaacgttacaggtgtgaggagtgtgggaaagcctttcgtcataactgtaagcgcagggctcatgaacgagagcatacaggggagaagccctatcaatgcagggattgtgggaaaaccttccaagataagcactgccttaccatccatcagagaatccacactggagagaaaccttacaaatgtttagagtgtgggaaagctttcagtgggaagtcaaacttgaccaatcatcgaagaattcacactggagagaagcctcacaaatgtgaggtatgtggaatggccttccatcatagttcagtcctgaggcagcacaaaagaatccacactggtgagaagccatacacctgcagtgagtgtggcacgtccttccgtcagggctcagctctgattggacataagcgagttcatactggggagaaaccttatgaatgtgaggaatgtggaaaagcttttagagtgagctcaaatcttactggacataagaaaagaaaacatcaagtatggagtacccatgaacttgatgggagtaggaaatccctctctccagtgactgtttctcagacctcagtagtcagtattttgaccagtgcctgagtataacgattctggtgttactttctgtttttcctacctcttaggctggtccttctgtctcttatattagttattcctgatttcctgacccttaattgtgagattccccaaagacattgtcctttaccttcttattcactattttttcagtgagcacatttacttccaagagtttatcaatcacttcctaatattaataaacacttattagtgctt

SEQ ID NO: 202104 - DNA, 2700 bp, Homo sapiens
  Payload ID: 19867
  Gene Name: zinc finger protein 311
  Uniprot ID: Q5JNZ3
  ENST ID: ENST00000383655
  CDS Start-End: 484-2484
taatttttaatccagcacatactattgcaagcgctgttttaggcgttgagaatacaactgtgaacaagacgacaaaaattcctgccctcatggagcctaagagcctaaattttagcgaaggtagaaccaccgtaaacaatgtatatattaataagtaacttatgcaccatactggaaaattataaagtgctatagaggaaaagaagaattcatgtaaagcaagggaaacaagatgtgagatcacagcggtttagtgttgctaatgaaccccaaatccagggcagtgtttgacacattaagccaaacagtagcggcactgtgggtcaagaagggccctttggctggcaccaccaaaacatgtgttctccaaaggaggctggcatcaactggagccacttcacagcttgtttgagaactggatctgaccagtaggaagaaaccaggacagcagtggaagactgttaaagaaacctgagtaaaaagatgcaggaggttgtgctgttggatgagagttcaggaccaccaagccagctgctttggacccgccaggatacccagctccctcaggaaagcgctctattacctgctccatatcctgccttcactaaagatggaagccaaggaaacctgccgcaagcagatatcacactaatgagccaggcccaagagtcagtgacatttgaggatgtagctgtgaacttcactaacagggagtggcagtgtctgacctacgctcaaaggcatctctataaggatgtgatgttggaaaattatgggaacatggtatcacttggatttccatttcctaaacctcctttaatctctcatctggagcgagaagtagacccctgtgtgcaggatccacaggacagggagtccctaagctgctcctacccagtgtcagctgacaagatgtggcctgagaatgaaaaggcaagttcacaacaagagatttttgaaaatggagaagcctactggatgaaatttaacagtctcctaaaagttgattcccgggatcctaaggttagagaagtttgtgttcaggatgtcaaattagagaatcaatgggaaacatctataagggagaaactgagagaagagaaagaaggctctgaggaagtgacctgcaaaaaaggaaagaaccagaaagtgcttagtaaaaacttgaatccaaactcaaaacatagtcaatgtaataaagttcttatagcacagaaactccatgaatgtgccaggtgtggcaaaaacttcagttggcactcagatctaattctccatgagcaaattcattctggtgagaaaccccatgtgtgtaatgagtgtgggaaagcattcaagaccagaaatcagctttctatgcaccggataatccacacaggggagaaaccttttaattgcacccagtgtgggaaggctttcaacagtagatcagctctttgccgacataaaaaaacccacagtggggagaagcctcacgagtgcagggactgtgggaaggccttcaagaccaggaaccgtctctgtatgcatcagcttatccacaccggggagaagccttacaaatgtaactgctgtgggaaggccttccagtttaagcattcccttaccatccatggcagaatccacactggggagaagccatatgaatgtgaggagtgcgggaaggccttcagtgggagttcagacctcaccaaacacataagaatccacactggggaacgaccttatgagtgcagcaagtgtggaagggccttcagtcggagctcagacctaagcaaacacaaacgaatccatactcgggagaaacactatgggtgtccccagtgtggaaaagacttcagcatcaaggcagaactcaccaaacacagaaggatccacactgaagagaaacgttacaggtgtgaggagtgtgggaaagcctttcgtcataactgtaagcgcagggctcatgaacgagagcatacaggggagaagccctatcaatgcagggattgtgggaaaaccttccaagataagcactgccttaccatccatcagagaatccacactggagagaaaccttacaaatgtttagagtgtgggaaagctttcagtgggaagtcaaacttgaccaatcatcgaagaattcacactggagagaagcctcacaaatgtgaggtatgtggaatggccttccatcatagttcagtcctgaggcagcacaaaagaatccacactggtgagaagccatacacctgcagtgagtgtggcacgtccttccgtcagggctcagctctgattggacataagcgagttcatactggggagaaaccttatgaatgtgaggaatgtggaaaagcttttagagtgagctcaaatcttactggacataagaaaagaaaacatcaagtatggagtacccatgaacttgatgggagtaggaaatccctctctccagtgactgtttctcagacctcagtagtcagtattttgaccagtgcctgagtataacgattctggtgttactttctgtttttcctacctcttaggctggtccttctgtctcttatattagttattcctgatttcctgacccttaattgtgagattccccaaagacattgtcctttaccttcttattcactattttttcagtgagcacatttacttccaagagtttatcaatcacttcctaatattaataaacacttattagtgctt

SEQ ID NO: 202105 - DNA, 2730 bp, Homo sapiens
  Payload ID: 19867
  Gene Name: zinc finger protein 311
  Uniprot ID: Q5JNZ3
  ENST ID: ENST00000458265
  CDS Start-End: 514-2514
agcatccattcatatattcattcagtcagctaatttttaatccagcacatactattgcaagcgctgttttaggcgttgagaatacaactgtgaacaagacgacaaaaattcctgccctcatggagcctaagagcctagattttagcgaaggtagaaccaccgtaaacaatgtatatattaataagtaacttatgcaccatactggaaaattataaagtgctatagaggaaaagaagaattcatgtaaagcaagggaaacaagatgtgagatcacagcggtttagtgttgctaatgaaccccaaatccagggcagtgtttgacacattaagccaaacagtagcggcactgtgggtcaagaagggccctttggctggcaccaccaaaacatgtgttctccaaaggaggctggcatcaactggagccacttcacagcttgtttgagaactggatctgaccagtaggaagaaaccaggacagcagtggaagactgttaaagaaacctgagtaaaaagatgcaggaggttgtgctgttggatgagagttcaggaccaccaagccagctgctttggacccgccaggatacccagctccctcaggaaagcgctctattacctgctccatatcctgccttcactaaagatggaagccaaggaaacctgccgcaagcagatatcacactaatgagccaggcccaagagtcagtgacatttgaggatgtagctgtgaacttcactaacagggagtggcagtgtctgacctacgctcaaaggcatctctataaggatgtgatgttggaaaattatgggaacatggtatcacttggatttccatttcctaaacctcctttaatctctcatctggagcgagaagtagacccctgtgtgcaggatccacaggacagggagtccctaagctgctcctacccagtgtcagctgacaagatgtggcctgagaatgaaaaggcaagttcacaacaagagatttttgaaaatggagaagcctactggatgaaatttaacagtctcctaaaagttgattcccgggatcctaaggttagagaagtttgtgttcaggatgtcaaattagagaatcaatgggaaacatctataagggagaaactgagagaagagaaagaaggctctgaggaagtgacctgcaaaaaaggaaagaaccagaaagtgcttagtaaaaacttgaatccaaactcaaaacatagtcaatgtaataaagttcttatagcacagaaactccatgaatgtgccaggtgtggcaaaaacttcagttggcactcagatctaattctccatgagcaaattcattctggtgagaaaccccatgtgtgtaatgagtgtgggaaagcattcaagaccagaaatcagctttctatgcaccggataatccacacaggggagaaaccttttaattgcacccagtgtgggaaggctttcaacagtagatcagctctttgccgacataaaaaaacccacagtggggagaagcctcacgagtgcagggactgtgggaaggccttcaagaccaggaaccgtctctgtatgcatcagcttatccacaccggggagaagccttacaaatgtaactgctgtgggaaggccttccagtttaagcattcccttaccatccatggcagaatccacactggggagaagccatatgaatgtgaggagtgcgggaaggccttcagtgggagttcagacctcaccaaacacataagaatccacactggggaacgaccttatgagtgcagcaagtgtggaagggccttcagtcggagctcagacctaagcaaacacaaacgaatccatactcgggagaaacactatgggtgtccccagtgtggaaaagacttcagcatcaaggcagaactcaccaaacacagaaggatccacactgaagagaaacgttacaggtgtgaggagtgtgggaaagcctttcgtcataactgtaagcgcagggctcatgaacgagagcatacaggggagaagccctatcaatgcagggattgtgggaaaaccttccaagatcagcactgccttaccatccatcagagaatccacactggagagaaaccttacaaatgtttagagtgtgggaaagctttcagtgggaagtcaaacttgaccaatcatcgaagaattcacactggagagaagcctcacaaatgtgaggtatgtggaatggccttccatcatagttcagtcctgaggcagcacaaaagaatccacactggtgagaagccatacacctgcagtgagtgtggcacgtccttccgtcagggctcagctctgattggacataagcgagttcatactggggagaaaccttatgaatgtgaggaatgtggaaaagcttttagagtgagctcaaatcttactggacataagaaaagaaaacatcaagtatggagtacccatgaacttgatgggagtaggaaatccctctctccagtgactgtttctcagacctcagtagtcagtattttgaccagtgcctgagtataacgattctggtgttactttctgtttttcctacctcttaggctggtccttctgtctcttatattagttattcctgatttcctgacccttaattgtgagattccccaaagacattgtcctttaccttcttattcactattttttcagtgagcacatttacttccaagagtttatcaatcacttcctaatattaataaacacttattagtgctt

SEQ ID NO: 202106 - DNA, 2730 bp, Homo sapiens; identical to SEQ ID NO: 202103
  Payload ID: 19867
  Gene Name: zinc finger protein 311
  Uniprot ID: Q5JNZ3
  ENST ID: ENST00000426120
  CDS Start-End: 514-2514

SEQ ID NO: 202107 - DNA, 2730 bp, Homo sapiens; identical to SEQ ID NO: 202103
  Payload ID: 19867
  Gene Name: zinc finger protein 311
  Uniprot ID: Q5JNZ3
  ENST ID: ENST00000429714
  CDS Start-End: 514-2514

SEQ ID NO: 202108 - DNA, 2730 bp, Homo sapiens; identical to SEQ ID NO: 202103
  Payload ID: 19867
  Gene Name: zinc finger protein 311
  Uniprot ID: Q5JNZ3
  ENST ID: ENST00000436574
  CDS Start-End: 514-2514

SEQ ID NO: 202109 - DNA, 2643 bp, Homo sapiens
  Payload ID: 19867
  Gene Name: zinc finger protein 311
  Uniprot ID: Q5JNZ3
  ENST ID: ENST00000452316
  CDS Start-End: 514-2514
agcatccattcatatattcattcagtcagctaatttttaatccagcacatactattgcaagcgctgttttaggcgttgagaatacaactgtgaacaagacgacaaaaattcctgccctcatggagcctaagagcctagattttagcgaaggtagaaccaccgtaaacaatgtatatattaataagtaacttatgcaccatactggaaaattataaagtgctatagaggaaaagaagaattcatgtaaagcaagggaaacaagatgtgagatcacagcggtttagtgttgctaatgaaccccaaatccagggcagtgtttgacacattaagccaaacagtagcggcactgtgggtcaagaagggccctttggctggcaccaccaaaacatgtgttctccaaaggaggctggcatcaactggagccacttcacagcttgtttgagaactggatctgaccagtaggaagaaaccaggacagcagtggaagactgttaaagaaacctgagtaaaaagatgcaggaggttgtgctgttggatgagagttcaggaccaccaagccagctgctttggacccgccaggatacccagctccctcaggaaagcgctctattacctgctccatatcctgccttcactaaagatggaagccaaggaaacctgccgcaagcagatatcacactaatgagccaggcccaagagtcagtgacatttgaggatgtagctgtgaacttcactaacagggagtggcagtgtctgacctacgctcaaaggcatctctataaggatgtgatgttggaaaattatgggaacatggtatcacttggatttccatttcctaaacctcctttaatctctcatctggagcgagaagtagacccctgtgtgcaggatccacaggacagggagtccctaagctgctcctacccagtgtcagctgacaagatgtggcctgagaatgaaaaggcaagttcacaacaagagatttttgaaaatggagaagcctactggatgaaatttaacagtctcctaaaagttgattcccgggatcctaaggttagagaagtttgtgttcaggatgtcaaattagagaatcaatgggaaacatctataagggagaaactgagagaagagaaagaaggctctgaggaagtgacctgcaaaaaaggaaagaaccagaaagtgcttagtaaaaacttgaatccaaactcaaaacatagtcaatgtaataaagttcttatagcacagaaactccatgaatgtgccaggtgtggcaaaaacttcagttggcactcagatctaattctccatgagcaaattcattctggtgagaaaccccatgtgtgtaatgagtgtgggaaagcattcaagaccagaaatcagctttctatgcaccggataatccacacaggggagaaaccttttaattgcacccagtgtgggaaggctttcaacagtagatcagctctttgccgacataaaaaaacccacagtggggagaagcctcacgagtgcagggactgtgggaaggccttcaagaccaggaaccgtctctgtatgcatcagcttatccacaccggggagaagccttacaaatgtaactgctgtgggaaggccttccagtttaagcattcccttaccatccatggcagaatccacactggggagaagccatatgaatgtgaggagtgcgggaaggccttcagtgggagttcagacctcaccaaacacataagaatccacactggggaacgaccttatgagtgcagcaagtgtggaagggccttcagtcggagctcagacctaagcaaacacaaacgaatccatactcgggagaaacactatgggtgtccccagtgtggaaaagacttcagcatcaaggcagaactcaccaaacacagaaggatccacactgaagagaaacgttacaggtgtgaggagtgtgggaaagcctttcgtcataactgtaagcgcagggctcatgaacgagagcatacaggggagaagccctatcaatgcagggattgtgggaaaaccttccaagataagcactgccttaccatccatcagagaatccacactggagagaaaccttacaaatgtttagagtgtgggaaagctttcagtgggaagtcaaacttgaccaatcatcgaagaattcacactggagagaagcctcacaaatgtgaggtatgtggaatggccttccatcatagttcagtcctgaggcagcacaaaagaatccacactggtgagaagccatacacctgcagtgagtgtggcacgtccttccgtcagggctcagctctgattggacataagcgagttcatactggggagaaaccttatgaatgtgaggaatgtggaaaagcttttagagtgagctcaaatcttactggacataagaaaagaaaacatcaagtatggagtacccatgaacttgatgggagtaggaaatccctctctccagtgactgtttctcagacctcagtagtcagtattttgaccagtgcctgagtataacgattctggtgttactttctgtttttcctacctcttaggctggtccttctgtctcttatattagttattcctgatttcctgacccttaattgtgagattccccaaagacattgtcctttacct

SEQ ID NO: 202110 - DNA, 5392 bp, Homo sapiens
  Payload ID: 19868
  Gene Name: zinc finger protein 316
  Uniprot ID: A6NFI3
  ENST ID: ENST00000382252
  CDS Start-End: 557-3571
ccggtgcccacgcgccgccgtcgcgcagctcccgggccgtcactttgtgtagcgcggggtccgccgccggcccgcaggccccggccccggtgtccggcccgtggctcggccagcccggcccgcgcggtctctgcaggaggaggcggctccggacgccccctggggggcgggaggcgctcggcccgtcgccccaggagcccgctttgtgaccttgggggccttatccgggctttccctcatctgcagaaggagccccggtgggctgctcggctgtcttctgctgccggcaggagctggtcctccaccttctctggtcatccgtgggtggacttcttgggagaaagaactcagtgtcgtctttggaggcagagactctccactgcttctggggaagaagcctgacctgccggcttcctggcacctgtctctcctcctagccccgttgtgccttgcaagtgcctgcatcctgtctgtgctgagacctcttggcgttccctgctggcctggttcatgtgtgttgaggaccaggccacgtggaggctcgctcccagggaggatggcggcgctccacacgactcccgactccccagctgcccagctggagcgggcagaggacgggtcagagtgcgaccctgaccaggaagaagaggaggaggaggaggaaaagggggaagaggtgcaggaggtggaagaagaggaggaggagatagtggtggaggaggaggaggagggtgtggcagaggtagtgcaggatgcgcaggtggaggcggtggccgaggtggaggtggaggcggacgtggaggaggaggatgtgaaggaggtgctggcagaggaggagtgtccggcgttggggacccaggagcgacttagccgtggtggtgatgccaagtccccagttcttcaggaaaagggcctgcaggcctcccgggctccagccactcctagggatgaggacctggaggaggaggaagaggaggaggaggatgaggacgaggatgatttgctgacggctgggtgtcaggagctggtgacgtttgaagatgtggctgtgtacttctccctggaggagtgggaaaggctggaagcagaccagcggggcctctaccaggaagtcatgcaggagaactatgggattctcgtgtccttgggatacccaattcccaagcccgatctgatcttccggctggaacaaggggaagaaccttgggtcccagatagtccccgacctgaggaaggagacatcgtcactggcgtctacacaggagcctggttctggacggacgacatagaggaccacgaggaggaagacgacgaggacttcctggcggaggtggccgaggaggagaacgagcccccagggctctggtcggcggcctacggcgtgggggacgtgcctgggacgtgggggcccgacgactcggattcggcgcagactccagaggggtggggacccgacccaggcggcctgggggtcctggccgacggctctgaagcgaagcctttcctgcccggccgggagccgggtgcgaacctgctgtcgccctgggcgttccccgccgcagtggccccgccggccgggaggccggagaccacgtgcgacgtgtgcggcaaggtcttcccgcaccgctcgcggctggccaagcaccagcgctaccacgcggccgtcaagcccttcggctgcgaggagtgcggcaagggcttcgtgtaccgctcgcacttggccatccaccagcgcacgcacaccggcgagaagcccttcccgtgcccggactgcggcaagcgcttcgtctacaagtcgcacctggttacgcaccgacgcatccatactggcgagcggccctaccgctgcgccttctgcggcgcgggcttcgggcgccgctcctacctggtcacgcaccagcgcacgcacaccggcgagcgaccctacccgtgttcgcactgcggccgcagcttcagccagagctcggcgctggcacggcaccaggcggtgcacacggccgaccgcccgcactgctgtcccgactgcggccaggccttccgcctgcgcgccgacttccagcgccaccgacgcggcgggggctgcgcggaggcgggtggtgacggcccccggcgggagcccggcgagacggcggccgccgcggggcccgaggacacggaccctgggccagagggatctgaagttggcgaggcggacggagaggcggaggccgcggccgaggagagagaggaggcggcggtggcggcgcccacccccagcggcaaggtggaccccgcgccggaacggcgcttcctggagctgggcaacggcctgggggagggcgaaggcccctcctcccacccgctgggcttccacttccccgtgcaccccaagtcctggctgcacccggacagcttcccgatcctgggcctacccgacttccgagagcggctgccggtcgacgggcgcccgctcccggcgcccctggggggcccgctctccctggtggagggtaccgggctggcgtgcgaccctttcggcggcggcggggccgcgggcggcggaggcggcctgcgcgcgttcgggcccgccatcgggggtctgctggcggagcccgcgccggccgcgctggcggaggaggagagcccgtggatctgctcggactgcggcaagacgtttgggcgccgggccgcgctggccaagcaccagcgctaccacgcgggcgagcggccgcatcgctgcgccgactgcggcaagagcttcgtgtacggctcgcacctggcgcgccaccggcgcacacacaccggcgagcggcccttcccgtgccccgagtgcggcgcgcggttcgcccgcggctcgcacttggcggcgcacgtgcgcggccacacgggcgagaagccgttcgtgtgcggcgtgtgcggtgcggggttcagccgtcgcgcgcacttgacggcgcacgggcgcgcgcacaccggggagcggccttacgcgtgtggagagtgcggccggcgcttcgggcagagcgcggcgctgacgcggcatcagtgggcgcacgccgaggagaagccgcaccgctgccccgactgcggcaagggcttcggccacagctcggacttcaagcggcatcggcgcacgcacacgggcgagaagcccttccgctgcgccgactgcggccgcggcttcgcgcagcgctccaacctggccaagcaccggcgcggccacacgggcgaacgccccttcccgtgccctgagtgcggcaagcgcttttcgcagcgctcggtgctggtcacgcaccagcgcacacatacgggcgagcggccctacgcctgcgccaactgcggccgccgcttctcgcagagctcgcacttgctcacccacatgaagacgcaccgcggagccaccgcagcgccgggctcgggttcggccccagcccccgcgcccaagcccgaggcggccgccaaggggccgtccagtgccggccccggtgagcgcggcagcgccctgctggagttcgcgggcggcacaagcttcggctccgagcaccaggccgcgttcgccgggccctcgggcgcctaccgggagggcgtcctgtgaggggcccggggccgacagcagcgcagcctgcagggccaccggcccctcccttggacggccggccccccgctcctcgggccccgggaggctgagggtcccagtcctgggtgcggtgccttccctcagccctcgccctgcggccccgggtctcatgcccgccgggtccgtgtgctcagccggagacgtgggggagctctggggagaagagcagcgcggaggcagcgaggccaggacgtcacccccacggagactgcgatatcccctgggtgggcccgggctgtgaagcagggcggtagttggcgggcgatgctatttatttcactcggattccgacttgggtggtctggggagcaagggatttgtgtgtttgcaaccgggtgtggcggcgagggaggggcccggccacccaggtgggccagcgggatgcctgggaggccggtgggtttggctgaccacttcttcccattcctcagtgagagacttgggccctcccggtcatccgagtctgtcccgaaggtttaactgcgcgcggcgaggggaggccttgtaggtttccaaagggcggagctccagtgggaaaacttgaaacttgtcgtctgcggatatttatttccacttcttgtatggcctgaagaatctaggaggagaaaaagccagataccaaacttacggccaggcagacgggtcgcgggtgttgacagggtcctgagggagtttgaagccttattctcgagccgcctcctcttctctacccacacttgcaccgaggtcaccccggcaccctccgcaccggttcggttttggtctctgcttgtcctctcagtccttggtactttcgtctccctcagccggaggtggcaaactcagacatctacgggcgcccgaggccctcgcagccctgagccccagctttcacttccctgggctgcccctctccgggagcaggcagacgccccgttctcggagcccagcgctcacttagagcgactgaggttggtcgaaggatctttccccacatcccataatcagggccctaggacactcgcaggtccctttaactctgcttctgtcattacactagaacaagtagtgtttctgtttagagtcccatttcacaaattggttagtggaggcacccgtggcctggcagcttgcacagtggctgtccacctcgggggggtgtggacctgagccgtggctcagtgacaaaccaggcacccaactatgcaaggcccctgcctggtgggcatcctaccctctggactgggcccatggaagccactgggcgggcagctggggtgtagttcatgtgaagccccattcccctcacgcttttggggccactgtgaatggggccaggaaacggatttttggtgcagctgcattccctaatagacctagttccctccacgttagtgtagacatggccttgggggctgagcgcagcagccaggctgccagggctgggggcgggtaggaggcacggtagttggtgggtgggaagagggcctgggtggtggcggtcagttagcctggctgggtgaggttggtgaggttgcggggcggggtggtgaggagagcaggggtcccagggaggcattggggtgctgggtaatgacctcggccctgggtttctcctctccctgcgggacaggagcctcagaaagggccaagggcaaggtgggcttggggggctctgggaatctcagctctagccctgtatggccaggatctgctgtctccgtccctcctgggccccagcagctgtcctgcagctgtcagcaggagggcctggctttaataaagagtggacaaactgaa

SEQ ID NO: 202111 - DNA, 520 bp, Homo sapiens
  Payload ID: 19868
  Gene Name: zinc finger protein 316
  ENST ID: ENST00000427912
  CDS Start-End: 401-520
tgcaagtgcctgcatcctgtctgtgctgagacctcttggcgttccctgctggcctggttcatgtgtgttgaggaccaggtaagcgtctctttgtcctgtgtatcaggtgctggcagaggaggagtgtccggcgttggggacccaggagcgacttagccgtggtggtgatgccaagtccccagttcttcaggaaaagggcctgcaggcctcccgggctccagccactcctagggatgaggacctggaggaggaggaagaggaggaggaggatgaggacgaggatgatttgctgacggctgggtgtcaggagctggtgacgtttgaagatgtggctgtgtacttctccctggaggagtgggaaaggctggaagcagaccagcggggcctctaccaggaagtcatgcaggagaactatgggattctcgtgtccttgggatacccaattcccaagcccgatctgatcttccggctggaacaaggggaagaaccttgggtcccagatagtccccgacctgaggaa

SEQ ID NO: 202112 - DNA, 4073 bp, Homo sapiens
  Payload ID: 19869
  Gene Name: zinc finger protein 317
  Uniprot ID: Q96PQ6
  ENST ID: ENST00000247956
  CDS Start-End: 306-2093
gagaattggaaggcggcagtgaagcggaagccattactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggggtatcaggtcggcaaacccagcctcatctcacacttggagcaggaggaggagccgaggacagaggagaggggcgctcaccagggcgcttgtgcagattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgc

SEQ ID NO: 202113 - DNA, 3955 bp, Homo sapiens
  Payload ID: 19869
  Gene Name: zinc finger protein 317
  Uniprot ID: Q96PQ6
  ENST ID: ENST00000360385
  CDS Start-End: 289-1980
agtgaagcggaagccattactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaa

SEQ ID NO: 202114 - DNA, 4186 bp, Homo sapiens
  Payload ID: 19869
  Gene Name: zinc finger protein 317
  ENST ID: ENST00000591278
  CDS Start-End: 271-591
actctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggaaattttggcaccaccattttgctgctcctaagtcagacttgtccaccctcagaacactgaagacccaagtgttgagcccaggctactggaaggggttgtcctctgcatggccctccctcaacctgtgtctttcccgtgagtgtagggtatcaggtcggcaaacccagcctcatctcacacttggagcaggaggaggagccgaggacagaggagaggggcgctcaccagggcgcttgtgcagattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgcta

SEQ ID NO: 202115 - DNA, 457 bp, Homo sapiens
  Payload ID: 19869
  Gene Name: zinc finger protein 317
  ENST ID: ENST00000591508
  CDS Start-End: 1-135
gcagattgggagactccatctaaaaccaagtggtcacttcttatggaagatatttttgggaaggaaacgcccagtggtgtgacgatggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgctatggatattt

SEQ ID NO: 202116 - DNA, 8006 bp, Homo sapiens
  Payload ID: 19870
  Gene Name: zinc finger protein 318
  Uniprot ID: Q5VUA4
  ENST ID: ENST00000361428
  CDS Start-End: 79-6918
ctgcggcggcgcgctccgagcctgcgtctagggcgcccccgggtcagagctgtcgccgtggccgccgctgcaagaaccatgtaccgcagcagcgctcgctcctccgtctcttcccaccggcctaaagacgacggcgggggcggcccgcgcagcggccgcagctctggctcctcctcaggcccggctcgccgcagctcaccgccgcctccgccctccggctcctcgtcgcggaccccggctcgccgaccccgctcgccctcagggcaccgcggccgccgggcctcgccgtccccgccacggggtcgtcgcgtctccccgtccccgcctcgggcccgtcgcggctccccgtcgccaccgcggggccgacgactcttcccgccgggcccggccggcttcagaggcagcagccggggggagtcccgcgccgactatgcccgggacggccgcggagaccatccaggcgacagcggcagccggagacgctctcctggtctgtgttctgactctttggaaaagagcttaaggatcactgttggcaatgaccacttctgtgttagcacaccagaacggcgacggcttagtgatcggctggggtcaccagtggataatctggaagacatggacagggatgacctgactgatgattctgtcttcactcgaagctcccagtgctctcggggtcttgagcgatatatttcccaggaggaagggcctctcagtcccttcttgggacaacttgatgaggactaccgaacaaaagaaactttcctgcatcgatctgattatagtccccatatcagttgtcatgatgagctgttgcggggaacagaacggaatcgagaaaaactcaaaggctactccatacgatctgaagaaaggagccgggaggccaaaagaccccgttatgatgacacagtgaagataaacagcatgggaggggatcacccaagttttacatcaggaactcgcaactatcgacagcgtagaagaagcccaagtcctaggtttctcgaccctgagtttcgagaactggatcttgccagacgaaagcgagaggaagaggaggagcgaagtaggagcttgagtcaggagctggttggagttgatggtggtggtactggctgttccatccctggattgtcaggtgtcctaacagcatcggagccaggatattctttgcatcggcctgaggaagtatctgtgatgcccaagaaatccattttgaagaagcggattgaggtggacataatggagccctccatgcagcttgagagtttttccagcagtaccagctccagccaggatcaccctctctactctgggcacccatcccttccactaagtggtgctattgctgcttttgcctcagagattgaaaacaaggggactatggtagagactgccttgaaggaacctcagggcaacctctaccaatggggtccccttcctgggattcccaaagacaacagtcctctcagagaaaaatttggaagttttctatgccacaaggataatttggatttgaaggctgagggacctgagcgacacacagacttcctgctgccccatgagagagctagccaggatggcagtggtttttcccgcattctgagcatgttggctgattctaccagtacacaggaaaaaaggcgacgtagctttcccgacattgaagatgaggagaaatttctctatggggatgaagaagaggatttaaaggcagaatccgtaccaaagccccttgggagctctgagagtgaagttatgaggcagaaggcaagctccctgccgtcttcagctccagctgtaaagctagaatcactagaagagaccaatccagaatatgcgaagatccatgacttgctcaagacaatagggctggatattggagtagcagagattagtcaattggctgcacgcacccaggaacgacttcatggcaagaagccatcattacgctcctcagctgaccgccgttcctcagttgaccgatacttttcagctgaccactgttcctcagttgaccaccgcttctcagctgaccgctgttcctcagttgaccactgcttctcagctgatcgacgttcctcagatccccacagactagagagcagggaggcacatcatagcaatacccactctccagaggtgtcccatccacacccaccttctcctgtggatccttacctgctcacaaaaaacagccctccattcctaaagtctgaccatccagtgggtcatatttcaggaccagaggtggttggtagtgggtttcagtcatctgttgcagtcaggtgcatgttgccatcagccccatctgccccaattagacttccacacactgctgctttatctcagtttcacatgccaagggcctctcagtttgctgcagctcggatacctccgaactaccagggacctgccattccccctgcctcttttgatgcctataggcactacatggcatatgcagcctccagatggcccatgtatcccacctctcaaccgtcaaaccaccctgtacctgaaccacacaggataatgccaataaccaaacaagctactcgtagccgtcccaatcttcgtgtgatccccactgtgactcctgataagcctaagcagaaagagtctctgcgaggctcaattcctgcggcccaagtgcctgtccaggtgtccattccatcactcataagatataatccagagaagatctctgatgagaagaaccgtgcttcccagaagcaaaaggttattgaagagagggaaaaactaaagaatgaccgggaagcccgccagaagaagatgtactatcttaggaccgagttagagcggcttcataaacaacaaggagaaatgctgcgcaagaaacgaagggagaaggatggccacaaagatcctctcttggtggaggtgagtcggcttcaggataacattatgaaggacattgcagagctacggcaagaggcagaagaggcagaaaagaagcaatctgaactggacaaagtggctcagatcttgggaattaacatcttcgataaatcccagaagtctttaagtgacagtagagagcctacagagaagcctgggaaagcagaaaaatctaagagcccagaaaaagtgtcatcgttctcaaactcctcctccaacaaggaatcaaaagtaaacaatgagaagtttcgtactaagagccccaagcctgccgaaagcccccagtcagccactaagcagttggatcagcccactgctgcttatgagtattatgatgctggcaatcactggtgcaaagactgcaacaccatctgtgggaccatgtttgatttcttcactcatatgcacaataagaagcacacacagacactggatccctacaacagaccttgggcttcaaagacccagagtgaggccaagcaagatgccataaagcgcactgacaagataactgttcctgcaaaaggctctgagtttctggttcccatcagtggattttattgccagctctgtgaggaatttttgggggatccaatttctggggagcaacatgtgaagggtcaccaacacaatgagaaatacaagaaatatgtggatgaaaacccattatatgaggagcggcggaatctggaccgccaagctggcttggctgtggtcctagagacagaacggcgacggcagagtgagctaaagcgcaaacttagtgagaaaccaaaggaggagaagaaagaaaaaaaggcaaaggctgtgaaagaagtaaaggaggatgacaaggtctctgagaaattagaagaccaactctctgagggtaggaactcccctgaaaaagctgaaaataaaaggaacactggcatcaaactccagttaaaagaagaggtaaagaaggaatcaccaacatcatcttcttttgggaaattcagctggaagaagccagaaaaagaagaggagaaaagttcattggtgaccccaagtatctctaaagaagagattctagaaagtagtaaggacaaagaggatggcaaaactgaagctgggaaggcaaagcctatcaaaatcaagctctctgggaaaactgttgttgcacataccagcccttggatgcctgttgtgacaacttccacacagactaagatccgacccaacctgcctattccatccacagtactccgcaagtcatgttcagccacaatgagcaagccagctcctcttaacacctttctgtctattaagtcctctggaaccactgctaaacctctgccagtggttaaagagtcttcagctgatctcctcttacctccagacatcatctccaaagcatttggaggggaagaggtgattctaaaagggtctccagaggaaaaagtggtgttggctgaaaagagtgagccatctcatttacctgaacaaatactaccacctcctccaccacccccacctccaccacctccaccaccccccgttatacctcatccagctgccccgtctgctgctcaagcaaatgctatcttggctccagtaaaatcaaacccagttgtatctcagactctcagccctggcttcgtgggtcctaacattttgaacccagtgttgcctgtagccatcatggcctcagcacagccagctgccattccttctgatgagacagctcctggggtgagtgagagtgaccgagaccagaccctgttctctgtgttagtacgtcctccaccacccctctcaagtgtgttcagtgaacaagccaaaaaattagagaagcgaaattcatgcttagccacagccaatgctaaggacctgtatgacatattctatagtagtggtggaaagggggcccctgagactaagggggcccctgagactaagctaagtggtggtccattggccaatggggaaaatagcaacctctctagaaccaaaagttcagacacctcttctacttctcctttgaacagcagtgcatcccaagaggagttgcatcaagatgagggtttggtcgctgctcctatagttagcaactctgaaaagcccattgcaaaaactctggtggccctagggaaatggtcagttgtagaacatgtaggcccaaaaagcacaggcagcacctatggcttcctacagcctctgacaaggttgtgccaaagcaggccttatgaaacaattaccccaaagacagacactttggccatatggacctctagttccttccagagtgacactagtagggatatatctccagagaagagtgagcttgacctgggagagccaggaccacctggtgtagaaccacctcctcaactgttagatatacagtgcaaagaatctcagaagttggtagaaatccacctcagagaatctgttaaccaggataaggaaagccaagagctccgtaaatctgaggattgtagagaaagtgagatagagacaaacactgaactaaaagaaagggtaaaggagctgtctgaggggatagttgatgagggagtaagtaccagcattggaccccacagcatagatgattctaatttgaaccatggaaacagatacatgtgggagggagaagtaaaacagcccaacttgctaatgattgacaaagaggctgaacagtccaataaattgatgacaggaagtgaaactccaagtaaagtagtgatcaaattgagtccacaggcttgctctttcacaaaggcaaaattagactcatttttatcagaagctaggtctttactcaacccacaagatacacctgtgaaaatttctgccccagagttgctgcttcattccccagccagatcagctatgtgtttaacaggtagtccacaagagcaaggagtttcagttgttagtgaggaggggctagagaattcagctccagaatcagcttctagaacttctaggtacagaagtctcaaactcaagagagaaagatcaaaagactttcaagttaaaaagatctatgagttggctgtttgggatgaaaacaagaagaggccagagacctgggagagcccagagaaaccaaaaacagaagcactggagctacaagatgtccatccagagttaacagtgacaatagaaagcaaggccctagaagactttgaagctacagacttaaaggtagaggagcttactgccctggggaatctgggggatatgcctgttgatttctgcactactcgggtaagcccagcacatagatccccaactgtcttgtgtcagaaagtgtgtgaagaaaattctgtatcacctatagggtgtaattcctccgatcccgctgacttcgaaccaatcccatctttttctgggtttccgttagattctcccaaaaccttggtgcttgactttgagacagagggtgaacgaaactcacctaatcccaggagtgttaggatcccttctcctaacattttgaaaactggacttacagaaaatgttgaccgtggcttggggggcctagagggaacacaccaggcccttgacctgttagcaggaggaatgatgcctgaggaagtaaaagaatcttcccaattagacaaacaagagtcactcggattggaattaaaaacaattaattctgcaggccttgggccatctccttgccttccagaccttgttgactttgtcacacggacctctggagttcaaaaagataaactgtgttctccactctctgagccaggtgacccttctaaatgtagttccctggagttggggccattacagctagaaatatcgaatgcatccaccacagaggtggcaattctgcaagtagatgatgacagtggcgaccctctgaatttggttaaagctccagtgtcaaggtcccctccaagggagcaggtaattgaagacaatatggtccctcagggaatgcctgaacaggaaactacagttggtgccatccaggaccacacagaatccagtgttcacaactaagaataaatacctagagctacttgtgagtgaatcattggcttctagaaatcagatgcccagatgatccaagactagtttgttatctcatctggaacctacaccaagagatgcagtcagcatcttaaagtaaatgttcatggaagctaaaaaatttacctcctttccttttccctttccccttaaaacaccagacaaatcgataacaacttatatatatatatatatatctgtaaaaatgtattttgttaatttttttggccaatttattttctcccactttgtcattaaaatcacatgtctaactggctcaccacatagtgtgctttgattgtattttggctttgactctgccatttctgaaatgtgggggaggatggaggcagctgacctctccagttgctgtgttgtattcctacccaatttcctgggcagttgatgcatctctgggaaaaacaccagaaagcttgctgaaatggaaaacttggaagaattgttcatctcttaggcttccatttggatgggcctgccttaacattgtttgaaatgcagcgtgagtagctcttttgtttactgtttacaccccttattggcatgtcaactcctgtacttcccttactctgttgcctttcttgagatgcattgtcctgctaacccacaaacctgtttggaaataaacatggaagaatatctggcaggcttacttttagaagacgacaaatcggtaaggcttattcatggttcattgccaggagcagatatgcttttgagatcacttttatttttgaaatggcctttgttcattgtattgtgatccaataacactttgtattaaattgtttagcagccatttgtgttgtgaaggggtagaagatctctgaaacttgtcttgagattgaactcattccctgttccacaaacccatatgtatcctttcctctacctcctcctttcccaattaatttcaaccatagtacgatgtttggggttgtatattttgttaaaaagattaaagaatttatgagttggcttggacaagtttaactttatttttaatgtgttaattacttggaataaatgcattaatctca

SEQ ID NO: 202117 - DNA, 525 bp, Homo sapiens
  Payload ID: 19870
  Gene Name: zinc finger protein 318
  ENST ID: ENST00000606599
  CDS Start-End: 1-239
agcctgccgaaagcccccagtcagccactaagcagttggatcagcccactgctgcttatgagtattatgatgctggcaatcactggtgcaaagactgcaacaccatctgtgggaccatgtttgatttcttcactcatatgcacaataagaagcacacacaggggcaattccaaaagtcttcagatttccaaaaggaaggactgcagcagacatttctgcccccagaaaggcagggatagaaaccacagaggccacggaaatgatgggtgcccttgtggccagtaggcaatcacctgaaggatctgacttccagaaggtgggtatgactgatgggggtggggataagttgtagagaagatcctgtcattttagctgccaggaaatggtgagttgggtgagtgaatgtgtatattgttgtacctgtagaggatgaacaagattagaatgtacatagagggtatgtattttagacttgccactcctcaccttatttagcattgaataaattattcctgaagtcccata

SEQ ID NO: 202118 - DNA, 3836 bp, Homo sapiens
  Payload ID: 19870
  Gene Name: zinc finger protein 318
  Uniprot ID: Q5VUA4
  ENST ID: ENST00000605935
  CDS Start-End: 114-3467
gcggcgcgcagcggccgaggtggcggcggctgcagctgcggcggcgcgctccgagcctgcgtctagggcgcccccgggtcagagctgtcgccgtggccgccgctgcaagaaccatgtaccgcagcagcgctcgctcctccgtctcttcccaccggcctaaagacgacggcgggggcggcccgcgcagcggccgcagctctggctcctcctcaggcccggctcgccgcagctcaccgccgcctccgccctccggctcctcgtcgcggaccccggctcgccgaccccgctcgccctcagggcaccgcggccgccgggcctcgccgtccccgccacggggtcgtcgcgtctccccgtccccgcctcgggcccgtcgcggctccccgtcgccaccgcggggccgacgactcttcccgccgggcccggccggcttcagaggcagcagccggggggagtcccgcgccgactatgcccgggacggccgcggagaccatccaggcgacagcggcagccggagacgctctcctggtctgtgttctgactctttggaaaagagcttaaggatcactgttggcaatgaccacttctgtgttagcacaccagaacggcgacggcttagtgatcggctggggtcaccagtggataatctggaagacatggacagggatgacctgactgatgattctgtcttcactcgaagctcccagtgctctcggggtcttgagcgatatatttcccaggaggaagggcctctcagtcccttcttgggacaacttgatgaggactaccgaacaaaagaaactttcctgcatcgatctgattatagtccccatatcagttgtcatgatgagctgttgcggggaacagaacggaatcgagaaaaactcaaaggctactccatacgatctgaagaaaggagccgggaggccaaaagaccccgttatgatgacacagtgaagataaacagcatgggaggggatcacccaagttttacatcaggaactcgcaactatcgacagcgtagaagaagcccaagtcctaggtttctcgaccctgagtttcgagaactggatcttgccagacgaaagcgagaggaagaggaggagcgaagtaggagcttgagtcaggagctggttggagttgatggtggtggtactggctgttccatccctggattgtcaggtgtcctaacagcatcggagccaggatattctttgcatcggcctgaggaagtatctgtgatgcccaagaaatccattttgaagaagcggattgaggtggacataatggagccctccatgcagcttgagagtttttccagcagtaccagctccagccaggatcaccctctctactctgggcacccatcccttccactaagtggtgctattgctgcttttgcctcagagattgaaaacaaggggactatggtagagactgccttgaaggaacctcagggcaacctctaccaatggggtccccttcctgggattcccaaagacaacagtcctctcagagaaaaatttggaagttttctatgccacaaggataatttggatttgaaggctgagggacctgagcgacacacagacttcctgctgccccatgagagagctagccaggatggcagtggtttttcccgcattctgagcatgttggctgattctaccagtacacaggaaaaaaggcgacgtagctttcccgacattgaagatgaggagaaatttctctatggggatgaagaagaggatttaaaggcagaatccgtaccaaagccccttgggagctctgagagtgaagttatgaggcagaaggcaagctccctgccgtcttcagctccagctgtaaagctagaatcactagaagagaccaatccagaatatgcgaagatccatgacttgctcaagacaatagggctggatattggagtagcagagattagtcaattggctgcacgcacccaggaacgacttcatggcaagaagccatcattacgctcctcagctgaccgccgttcctcagttgaccgatacttttcagctgaccactgttcctcagttgaccaccgcttctcagctgaccgctgttcctcagttgaccactgcttctcagctgatcgacgttcctcagatccccacagactagagagcagggaggcacatcatagcaatacccactctccagaggtgtcccatccacacccaccttctcctgtggatccttacctgctcacaaaaaacagccctccattcctaaagtctgaccatccagtgggtcatatttcaggaccagaggtggttggtagtgggtttcagtcatctgttgcagtcaggtgcatgttgccatcagccccatctgccccaattagacttccacacactgctgctttatctcagtttcacatgccaagggcctctcagtttgctgcagctcggatacctccgaactaccagggacctgccattccccctgcctcttttgatgcctataggcactacatggcatatgcagcctccagatggcccatgtatcccacctctcaaccgtcaaaccaccctgtacctgaaccacacaggataatgccaataaccaaacaagctactcgtagccgtcccaatcttcgtgtgatccccactgtgactcctgataagcctaagcagaaagagtctctgcgaggctcaattcctgcggcccaagtgcctgtccaggtgtccattccatcactcataagatataatccagagaagatctctgatgagaagaaccgtgcttcccagaagcaaaaggttattgaagagagggaaaaactaaagaatgaccgggaagcccgccagaagaagatgtactatcttaggaccgagttagagcggcttcataaacaacaaggagaaatgctgcgcaagaaacgaagggagaaggatggccacaaagatcctctcttggtggaggtgagtcggcttcaggataacattatgaaggacattgcagagctacggcaagaggcagaagaggcagaaaagaagcaatctgaactggacaaagtggctcagatcttgggaattaacatcttcgataaatcccagaagtctttaagtgacagtagagagcctacagagaagcctgggaaagcagaaaaatctaagagcccagaaaaagtgtcatcgttctcaaactcctcctccaacaaggaatcaaaagtaaacaatgagaagtttcgtactaagagccccaagcctgccgaaagcccccagtcagccactaagcagttggatcagcccactgctgcttatgagtattatgatgctggcaatcactggtgcaaagactgcaacaccatctgtgggaccatgtttgatttcttcactcatatgcacaataagaagcacacacaggggcaattccaaaagtcttcagatttccaaaaggaaggactgcagcagacatttctgcccccagaaaggcagggatagaaaccacagaggccacggaaatgatgggtgcccttgtggccagtaggcaatcacctgaaggatctgacttccagaaggagggtagaaattacaaataagcgctttatagctctgcctgttccaaaagcccaggagaagaagaggaaaagcccaatcattttggatttgggaagagggtggaatttgactcctgattctgtgaccttgagcttcatagaggaaatgaaagactcctctatggaaagagaagcttcgaacccattagtggacatttccaattccatctccttgactggccaaccactaatctactgtctgtctctgtggatttacctattctaaatatttcatatgaattgattcatatga

SEQ ID NO: 202119 - DNA, 4221 bp, Homo sapiens
  Payload ID: 19871
  Gene Name: zinc finger protein 319
  Uniprot ID: Q9P2F9
  ENST ID: ENST00000299237
  CDS Start-End: 624-2372
cacagcggacctacaggcgctcagagaagcccaccttccccctctctgtcccgagaaggcttagagtggtacctgcttgctcaagcaacctgctgcctccacccagagcagccgctcctctcctccctcccttccggaagatgctgaggatgacagcttttagcctgactcttacatttctttggcagagcagttagaggccagactgtcctgtgaaggcttctccttccttcttcctctgctcaggagaaaacttacaaacttttaaatgtaagaggcagatgagctgggaacctggaagtgggttgcatctgactctgaaagttcctccctctcgctggcattacctcatgctgccacaaagtgaacggatcactggggaaggcagagtctccccggcactgctgggaccctcccttgaagagcccccatgtcctgtaggcagagccttgtagtctgtccgcttggttactgactcgggctgtctgaccagcccctcttctgtgccttgtctgaggtccttgtccatctctgtgattgggcagcttctctctctggattgggtcacgtgaagcgggaaactgaagccattactctccaaaccctgtttcatcttcccaagcatgtcggaaagctggcaacagccgccacagacgcagccgcagcagccacagccaccgcagcctcagcaccatgcagagccaccgccagccctggcagagcacacgctgcctccgggcacggcggagaaccccctgggctgtgccgtctatggcatcctcctgcagccagaccccggcctgcagcccccacaacacgcacccctgcaggcagcaggagagccaggccccaaatgtggcgtgtgtggtcacgacctggcgcacctgtccagtccgcatgagcaccagtgtctggcgggccatgaccgctcattccagtgcacacagtgtctcaagatcttccaccaggccactgacctgctggagcaccagtgcgtgcaggctgagcagaagcccttcgtctgtggggtctgcaagatgggcttctcactactcacctcactggcacagcaccacagctcccacagtggcctggtgaagtgttccatctgtgaaaagacctacaagccagctgaggcagcggagccagccaccacagccgccccgtcgcttcccgcagcacccgcgccttccactgtcacccctgctgaacaggccgacaagccctacagctgccccatctgccaaaagcccttcaagcacctgtcggagctctctcggcatgagcggatccacaccggtgagaagccctacaagtgcacgctgtgtgacaaaagcttcagccagtcgtcgcacctggtgcaccacaagcgcacgcacagctccgagcggccctacaagtgcgcagtctgcgagaagaccttcaagcaccgctctcacctggtgcgccacatgtacgcgcactcgggcgagcaccacctgttccgctgcaacgtgtgcgagttgcatttcaaggagtcgtcggagctgctgcagcacccgtgcacgccaagtggggagcggcccttccgctgcggcgagtgccagaaggccttcaagcggccctcggacctgcggcagcatgagcgcacacacagcgccgagcggcccttcaagtgcgacctgtgccccatgggcttcaagcagcagtacgcactgatgcgccaccggcgcacacacaagaccgaggagcccttcaaatgcggcctatgtgagaagggctttgggcagcccagccacctgctctaccaccagcacgtgcacaccctcgagactctcttcaagtgccccgtgtgccagaaaggctttgaccaatctgccgagctgctgcggcacaagtgcctgcccggcgcggccgagcggcccttcaagtgccctgtgtgcaacaaggcctacaagcgcgcgtcggccctgcagaagcaccagctggcccactgtgcggcggcagagaagcccctgcgctgcacgctttgcgaacgccgcttcttctcctcttccgagttcgtgcagcaccgctgcgatccggcccgcgagaagccactcaagtgcccagactgcgagaaacgcttcaagtacgcgtcagacctgcagcggcaccggcgggtacacacaggcgagaagccctacaagtgccccaactgcgacaaggccttcaagcagcgggagcatctcaacaagcaccagggcgtgcacgcccgcgagcagcagttcaagtgtgtatggtgcggggagcgcttcctagacgtggccttgttgcaggagcacagcgcgcagcacagtgccgccgccgcggcagcggagggcgcctaccaggtagccgcctgcctgccctgactctgcggctgtggcccctaccagcctgacctgagtcggcgccgtgggcccagcaggcctcgcgcagcctagctcctcacagctgccttgcaccaagggccccacccagctcggtgttctgagacctcgggagtgaggacgcaggggtatgaggcagggagagggtgtgccgctcgtactcctggcaccagcgggcagtgcgggcggccagattgctgtggcccatcctgattccacaaacctctttcccatgacaagattcactttcttgagagccatcagcaccccccttatttccggggcactggagccaggctggaagtcaagtggcttctccctgccctaaggagggtgtgatgccagcccaaccttcccatatctttcaagctagcagccacataggttaggaaagcggaggctcatggtggggctggggccccagaggtgggctaggtgtaaggcatcagttgccgtgtgggggagaaggccagctttaagacgtaggcctggggactgggagggcagagggtgagtcacagccctctccgtctgctctagccaggggcgacgtgtccccaggtttctggcaggggagatgtgcagggtgggtcttggggctgggtctgcctggagaccagtgggcccagggggaagggggaagctgagaagttcgtgtgacaccctcagccaagggacagtgccatccttggggacaggaggaaaagcagcctgtctctgctaagggcaaatcctccggttttggaagcgcccctcccacctttgtagtgcagttcctaggtgtggtggggaatgtgccgtgctctcagcagacagaactgctggtgtgaaaggcagggattgtcagcccacctgaggctgggaggaagcaggaccaggcctaggatctccccagcagatgcaaacaagtgtcctcccctgaattgtgtgaaccaaagcgtcaggggcttggggcacagccccagtcagctcaacccagtcctgcttcagagccaagactaggccagggtggggacccccccagtaccctccctacatcaatgtggctgctggcctggaccccaggggtctggtacagccaagatgttctggacaacatccagctacttcaaaggccagagtgtcctttgggtcctcctagagtccccctaggtctctggctgcccatgaggctcatgaagcagagggtatcccagtcatagggagcagaaagagcaagtgggttaaggaagcctgtgggggacctggtggatggagttgaccaacatcgctgggtggctacggccctccttaggaagcccagaaggacctttattattaaaataatcattttgaaccctgctctatcccctgccctcttccagccccacccctccctggtcttgaaagaagactaatcagtgggcacaccaagggccctgaggggcagggagatgccaccatgcttctctgtcaccgtaagaaggctgaccagccacgcccacctcctctgtctgactgagttccttcctgtggccacagggaggggctggtccttcccctcggtgctggctctctgtcacaatgcctcaaaagacatggaacccaggcctacaaccgtcccaactgctaattcttttcctttcattttgctttctgaaagcagtttgttatactattcataacattgtagagtttaatttcatgtcattttggatcttatataaaaatgtgaggatttggatttttaaaaagaatgactccattttaggtagccacttttgatgttaatatatagtgagtccaatgtatgctttagaagtaaagacattgaccgtcacagaccactgca

SEQ ID NO: 202120 - DNA, 517 bp, Homo sapiens
  Payload ID: 19871
  Gene Name: zinc finger protein 319
  ENST ID: ENST00000562909
  CDS Start-End: 311-517
gagcagctggtcgccgctcgccccgcgcctgccctgcaggcggcctggagcagaacggatcactggggaaggcagagtctccccggcactgctgggaccctcccttgaagagcccccatgtcctgtaggcagagccttgtagtctgtccgcttggttactgactcgggctgtctgaccagcccctcttctgtgccttgtctgaggtccttgtccatctctgtgattgggcagcttctctctctggattgggtcacgtgaagcgggaaactgaagccattactctccaaaccctgtttcatcttcccaagcatgtcggaaagctggcaacagccgccacagacgcagccgcagcagccacagccaccgcagcctcagcaccatgcagagccaccgccagccctggcagagcacacgctgcctccgggcacggcggagaaccccctgggctgtgccgtctatggcatcctcctgcagccagaccccggcctgcagcccccacaacacgcacccctgcag

SEQ ID NO: 202121 - DNA, 1137 bp, Homo sapiens
  Payload ID: 19872
  Gene Name: zinc finger protein 32
  Uniprot ID: P17041
  ENST ID: ENST00000374433
  CDS Start-End: 125-946
ctggcgctgctgcgggctcggcgccggcctttgtctgcgggcacgcgccgctgcggtgctcaggaacagcccatggaagaatcatatgaagaggtggtgactgaggtcgtaagcaggagtggacatgtttggatttccaacagctaccctgctggactgtcatggaagatatgcccagaatgtagcgttcttcaatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaaggtagtctaacgttacatgagagaatccacactggtcaaaagccttttgagtgcacccactgtggaaaaagcttcagggccaaaggcaatcttgttacacatcaacggatacacacgggagagaagccttatcagtgcaaggagtgtgggaaaagcttcagtcaacgaggtagtctcgctgtccacgagagactccacactggacagaaaccctacgagtgtgctatttgtcagagaagcttcaggaatcagagtaaccttgctgttcacaggagagttcacagtggtgagaagccctatagatgtgatcagtgtggaaaagccttcagtcagaaaggaagcttaattgttcacatcagagtccacacaggcctgaagccctatgcctgtacccagtgcaggaagagtttccacaccagggggaattgtattctgcatggcaaaatccacacaggagagacaccctatctgtgcggccagtgtggaaaaagcttcacccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcattatca

SEQ ID NO: 202122 - DNA, 1201 bp, Homo sapiens
  Payload ID: 19872
  Gene Name: zinc finger protein 32
  Uniprot ID: P17041
  ENST ID: ENST00000395797
  CDS Start-End: 190-1011
gcggccgccaaggaaatgagcaggcctggccggcccgggccccgagggaggccagccgcgagcggagaggtcggcggtccgcagagcagggtcccgtggaccggagagcgggatgccgaggtgctcaggaacagcccatggaagaatcatatgaagaggtggtgactgaggtcgtaagcaggagtggacatgtttggatttccaacagctaccctgctggactgtcatggaagatatgcccagaatgtagcgttcttcaatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaaggtagtctaacgttacatgagagaatccacactggtcaaaagccttttgagtgcacccactgtggaaaaagcttcagggccaaaggcaatcttgttacacatcaacggatacacacgggagagaagccttatcagtgcaaggagtgtgggaaaagcttcagtcaacgaggtagtctcgctgtccacgagagactccacactggacagaaaccctacgagtgtgctatttgtcagagaagcttcaggaatcagagtaaccttgctgttcacaggagagttcacagtggtgagaagccctatagatgtgatcagtgtggaaaagccttcagtcagaaaggaagcttaattgttcacatcagagtccacacaggcctgaagccctatgcctgtacccagtgcaggaagagtttccacaccagggggaattgtattctgcatggcaaaatccacacaggagagacaccctatctgtgcggccagtgtggaaaaagcttcacccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcattatc

SEQ ID NO: 202123 - DNA, 6074 bp, Homo sapiens
  Payload ID: 19873
  Gene Name: zinc finger protein 320
  Uniprot ID: A2RRD8
  ENST ID: ENST00000391781
  CDS Start-End: 121-1650
ggggtgtgttgattctcagtgataaacaacatatttctaacatttaggattgacttctaaagactcttggtacctgaggaagaaacccagaagaggaagaggaaagcaaaggagtcggggatggctctttctcagggtctactgacattcagggatgtggccatagaattctctcaggaggagtggaaatgcctggaccctgctcagaggactctatacagagacgtgatgctggagaattataggaacctggtctccctggatatctcttccaaatgcatgatgaatacattgtcatcaacagggcaaggcaatacagaagtgatccacacagggacattgcagagacaagcaagttatcacattggagcattttgctcccaggaaattgagaaagacattcatgactttgtgtttcagtggcaagaagatgaaacaaatgaccatgaagcacccatgacagaaataaaaaagttgactagtagtacagaccgatatgatcaaaggcatgctggaaacaagcctattaaaggtcagcttgaatcaagatttcatttgcatttgcgaagacataggagaattcatactggagagaaaccttacaaatgtgaagaatgtgagaaagttttcagttgcaaatcacatcttgaaatacataggataattcatactggagagaaaccatacaaatgtaaggtttgcgacaaggcttttaagcatgattcacacctggcaaaacatactagaattcacaggggagacaaacattacacatgtaatgaatgtggcaaggtttttgatcaaaaagcaacccttgcatgtcatcatagaagtcatactggagagaaaccttataagtgtaatgagtgtggcaagacctttagtcagacatcacaccttgtgtaccatcatagactgcatactggagagaaaccttacaaatgtaatgagtgtggcaagaccttcgctcgaaattcagtcctcgtaattcataaggcagttcatactgcagagaaaccctataagtgtaatgaatgtggcaaggtttttaagcaacgagcaactcttgcaggacatcgtagagttcacactggagagaaaccttacagatgtgaagaatgcgacaaagttttcagtcgcaaatcacatcttgaaagacataggaggattcatactggagagaaaccatacaaatgtaaggtttgtgacaaggctttccggagtgattcacgtcttgcagaacatcagagagttcatactggagagagaccttacacatgtaatgaatgtggcaaggtttttagtacaaaagcgtacctcgcatgtcatcaaaaacttcatactggagagaaactttacgaatgtgaagaatgtgacaaagtttacattcgcaaatcacaccttgaaagacataggaggattcatacaggagagaaacctcacaagtgtggtgattgtggtaaagcctttaattcaccttcacaccttattaggcatcagagaatccatactggacagaaatcttacaaatgtcatcagtgtggcaaggtctttagtctgaggtcactccttgcagaacatcagaaaattccttttggagacaattgtttcaagtgcaatgagtatagcaaaccatcaagcattaattgacatcagagtcaaatcagcattgacctgagtttgagttgacttaacattgatttcaagcattaatcgacattaaactgtttatgttaagaggattgggccaggcgtggtgtctcacacctgtaatcccagcactttgagaggccaagacaggtaggtcacttgaggtcatgaatttgagaccagcctggccaacagacgggagccacttttcccagcctgtatgttcttttatttatttatttatttttaagatggaatcttgctctgtcgcccacgttggagtgcagtgatgtgatctcggttcactgcaacattcacctcccaggttcatgcaattctcctgcctcagtctcctgagtagctgggactacaggtgcgtgccaccatgcccgggtaattttttgtatttttagtagagactgggtttcaccgtgttagctaggatggtctcgatcttctgtccttaaaatccacctgcctccacctgccaaagtgctgagattacaggcgtgagccaccacacctggcctgttttttgtttctttaacaaaaagttatagaaatttctctgggtattgtgttgaatctacatcacattcagttataatcatttagcaatattattccattcaatatggcttgtatctcttatttgcacatgtttttatcactttgatcaatgtttgtagatttgaaggtagaaacttctcaacttttttcatttattcctaagtatttcttactttaagttctttagcaaatgaaagtgtttttttaattttctttttaaattgtttattgttaatgtatggaaattcaactaatttttggtgctgttattctattcttcaaatccactgcatatgttttttagttccagttgcattttggttgactctttgtgattttctacacagaagatcatgtcatctacaaagaaatagttttacttctttctttctgatttggatgagtttgatttcttttgctatttcattgctctagctaggacagccagtattgattgaatagaaggggtgagagcattcttgcatcatgtgagatcctacaggaaaagcattccattttccctgactggttatttctgctgtggtcatttcatggatggtctttgtattgttgaggtaaatttccttctctttctattttgtttaggatttccatgatgactggatgttgaattttgtgaaatgctttttctccatgtattgagatgatgtggttttcatctttcattatgttcaagtggtatatcacattgatttgcttgactatgttgaaccattttgcatcccagaaataagtggcacttgcatatcaacaatcctttttataacctcttgaatacagttcgctagtacaaggggtcttcaggaagttcatggaaaaatacatattatgagaaaattgtgcatgatatcacattttttgcaccaagataaactgatacaaatccgttataacatgtctgaacagggtttggtttgaggcactcagatgggtaagacatgagtttgaaaagagactcaatcaaggcaatgtaaattctgctaaaactgaaacaagaagaaacatcaaatttgcgatgagaccagatgctgtggctcaggcctgtaatcccataattttcagaggctgagacagttgggtcacgtgggccccggtactcaagaccagcctgggcagaatggtgaaaccaccttctctacaaaaaatacataaattagctgggcattgtggcacatgtctgctggttcagcttctgtggagtctgcagtgggaggatggcttgagcctaggagttcgaggctgcagggagccatgatcatgccattgtactccagcatgggtgacagagacagatagtgtatcgaaaaatgaatctggtaaagtttgggtagagggacaatgaaatcattgatgctttatgaaaaggttatggggacgattcccaaaataaatcaccagtttgtaaatggaaaacttattttaagttgggacaagatgatgttgaaagtgatgcacaggacaggtgtggtggctcacacctgtaatcccagcactttgggaggccgaggcaagagcatcacgaggtcaggagatcgagaaaatcctggctaacacggtgaaaccccatctctactaaaaatacaaaaaattagccaggcgtggttgtgggcgcctgtagtcccagctactcaggaggctgaggcaggagaatggcatgaaccgaggaggtggagcttgccatgagcagagatcatgctactgcactccagcctgggtgacagagcgagactccatctcaaaaaaaaaaaaaaaaaaaaaaaaaagaaagtgatgcacagagtggcaggcagaccatccacataagttttataggtacaactgtcaaagacgacactggagaagagccaagctggatctataaggaattgcatatgagatggcacacatattcatgctgtctgaagattcagtcacgttaccatatcaagctgaaaatgtcaccactatctggagagttggacatgttttattgagaatgtattttttttctctggatctgttatgaacacctttgttggcttggttcagtaataaatatgtgagacttttcatttaaaaaaagtcaaatgacttaattctgtattttaaattctgttttgtttgttttgtttttttgagatggagtcttctgaaaattttctcatcttctctaacccggttcatgacagacccttggactttactgttgtggaaaaatctatataaaacagtatcagtgtgtcaaagcattatggctgtcacaagcttgtgaaaggaaaataaaaattactaagccaaagagaaaagtcaatctgggaactgcgtcagacaaacctgccttccattttattcctaaacaagatagttacaaagattttttaaaaagctacatatgcccctcccaaaccgggaacctcaagatctccaccctaaaatagttctgttgaatttcaccctggcgatgtaaactgagagcttatcttcacagatgtgggaaagagcccatccctctgcacacctgagtcaaatgtctatctgattgcttcccttgccctatttatgtaaaaatacagggtccctgagccagcctaaggcataagtgacttatccctcctccctgctcacatataaattgtgtatttagtgaaaggctgatcaaagattcaaagaatgttatttgttatctacctgtgacccagaaggtccccaattccagttattccacctttccagaccggaccaatgtatatatgtactgattgctgtctcgtgtgtctgtaaaatgtgtgaaaccaaactgcagcctcaacaccatggacacacgtcatcaggacctcctgaggttcgtgttaattggccttagactctccctgtccccagacccaggacgcatgtgtttcctttttcttcatttctattaaagatgggtctcattctgttggccaggcatgagagcggtgacaggatcagccctcactgaagcttcaatctcctgggttcaagggatcctcccacctcagcctccaaagttgctaggaccatagccaggtgccaccgcaccgggcaaatttttgtgttcctagtagagatgggctttcaccatgttgcccgagctggtcttgaattccagggctcaagcgatccagccgtattggcctcccaaggtgctgggattacagccatgagccaccatgaccaacgtgtttcttaatttaaaaaaaaaaaaatagaccaggtgctctggctcatgcctgtaatcccagcactttgggaggccaaggtgggcagatcacctgagatcaagtatttgagaacagcctggctaacatggcgaatcctcgttttgaccaaaatatagaaattagcctggtgtggtggcgagtgcctgtaatcccagctattcaggagggtgaggcagaagaatggcttgaattcgggaggcggaggttgcagtgagctgagatcctgcaactgcactctggctgggcaagagcgagactccatctctaaaataaaattaaagtaatataaaaaactgcttctcatgaaagctttggtataatcttacgaggtaacatcattgttttgcaactacggtatgtgttcaaaatgttcttctttgaccccacatttcattagatatatttttaagccattttaaaattgtttttctctgaaatttattgtgtttagtttacattgaggactgcatgctttctagtctgtatcatacattggaaacattttctagtacctgataaatgattttaggttgtttcgatgtgtacttgataaagatatcaaggaactttttctttatgctaacattaaaatttagttgaagtagcctatta

SEQ ID NO: 202124 - DNA, 658 bp, Homo sapiens
  Payload ID: 19873
  Gene Name: zinc finger protein 320
  ENST ID: ENST00000597091
  CDS Start-End: 192-658
agtctcactctgtccttcaggctgtgagtgcagtctcctgatcttggctcactgcaacctctgtctcctgggttcaagtgattcttgtgcctcagcctaccaagtagctgagatacaggattgacttctaaagactcttggtacctgaggaagaaacccagaagaggaagaggaaagcaaaggagtcggggatggctctttctcagggtctactgacattcagggatgtggccatagaattctctcaggaggagtggaaatgcctggaccctgctcagaggactctatacagagacgtgatgctggagaattataggaacctggtctccctggggcaaggcaatacagaagtgatccacacagggacattgcagagacaagcaagttatcacattggagcattttgctcccaggaaattgagaaagacattcatgactttgtgtttcagtggcaagaagatgaaacaaatgaccatgaagcacccatgacagaaataaaaaagttgactagtagtacagaccgatatgatcaaaggcatgctggaaacaagcctattaaaggtcagcttgaatcaagatttcatttgcatttgcgaagacataggagaattcatactggagagaaaccttacaaatgtgaagaatgtgagaaagtttt

SEQ ID NO: 202125 - DNA, 590 bp, Homo sapiens
  Payload ID: 19873
  Gene Name: zinc finger protein 320
  ENST ID: ENST00000594741
  CDS Start-End: 333-590
cgcgtgagtttcgctctgttttatgtgtgcttcccagtcctgtggtgctgctataccggggacgttgagtccccacagacctggaaattgcggcccctctttctcaacccagagcaaattgagacgtccgggtgagagtccagtctcactctgtccttcaggctgtgagtgcagtctcctgatcttggctcactgcaacctctgtctcctgggttcaagtgattcttgtgcctcagcctaccaagtagctgagatacaggattgacttctaaagactcttggtacctgaggaagaaacccagaagaggaagaggaaagcaaaggagtcggggatggctctttctcagggtctactgacattcagggatgtggccatagaattctctcaggaggagtggaaatgcctggaccctgctcagaggactctatacagagacgtgatgctggagaattataggaacctggtctccctggatatctcttccaaatgcatgatgaatacattgtcatcaacagggcaaggcaatacagaagtgatccacacagggacattgcagagacaagcaagttatcacattggagcattttgc

SEQ ID NO: 202126 - DNA, 552 bp, Homo sapiens
  Payload ID: 19873
  Gene Name: zinc finger protein 320
  ENST ID: ENST00000597111
  CDS Start-End: 476-552
acagcgcgtgagtttcgctctgttttatgtgtgcttcccagtcctgtggtgctgctataccggggacgttgagtccccacagacctggaaattgcggcccctctttctcaacccagagcaaattgagacgtccggttgtatcttaattcagtgagcttccaactttttggggggtggaggtgatggagtttcgctgtgtcccccaggctggagggcagttgtgcgatcttgattcacttcaacctctgctctccgggctcaagcaattctcccacctcagcctgagtctcactctgtccttcaggctgtgagtgcagtctcctgatcttggctcactgcaacctctgtctcctgggttcaagtgattcttgtgcctcagcctaccaagtagctgagatacaggattgacttctaaagactcttggtacctgaggaagaaacccagaagaggaagaggaaagcaaaggagtcggggatggctctttctcagggtctactgacattcagggatgtggccatagaattctctcaggaggagtggaaatgcctgga

SEQ ID NO: 202127 - DNA, 583 bp, Homo sapiens
  Payload ID: 19873
  Gene Name: zinc finger protein 320
  ENST ID: ENST00000597265
  CDS Start-End: 412-583
ttcaagtgattctcctgcctcaaccttcctgagtagctgggattacaaccatgagccaccatgcctagataatttttgtatttttagtagagacgggggtttctccatattgctcaggctggtctcgaactcctgacctcaggtgatctgcctgccttggcctcccaaagtgctgtgattacaggcctcagccaccctgcctggcctccctgttttcaagagtctcactctgtccttcaggctgtgagtgcagtctcctgatcttggctcactgcaacctctgtctcctgggttcaagtgattcttgtgcctcagcctaccaagtagctgagatacaggattgacttctaaagactcttggtacctgaggaagaaacccagaagaggaagaggaaagcaaaggagtcggggatggctctttctcagggtctactgacattcagggatgtggccatagaattctctcaggaggagtggaaatgcctggaccctgctcagaggactctatacagagacgtgatgctggagaattataggaacctggtctccctggatatctcttccaaatgcatgatgaatacat

SEQ ID NO: 202128 - DNA, 598 bp, Homo sapiens
  Payload ID: 19873
  Gene Name: zinc finger protein 320
  ENST ID: ENST00000593618
  CDS Start-End: 229-598
aagcggatggcagggactgaaggtcacaccacagcgcagtctcactctgtccttcaggctgtgagtgcagtctcctgatcttggctcactgcaacctctgtctcctgggttcaagtgattcttgtgcctcagcctaccaagtagctgagatacaggattgacttctaaagactcttggtacctgaggaagaaacccagaagaggaagaggaaagcaaaggagtcggggatggctctttctcagggtctactgacattcagggatgtggccatagaattctctcaggaggagtggaaatgcctggaccctgctcagaggactctatacagagacgtgatgctggagaattataggaacctggtctccctggatatctcttccaaatgcatgatgaatacattgtcatcaacagggcaaggcaatacagaagtgatccacacagggacattgcagagacaagcaagttatcacattggagcattttgctcccaggaaattgagaaagacattcatgactttgtgtttcagtggcaagaagatgaaacaaatgaccatgaagcacccatgacagaaataaaaaagttgactagtagtacag

SEQ ID NO: 202129 - DNA, 754 bp, Homo sapiens
  Payload ID: 19873
  Gene Name: zinc finger protein 320
  ENST ID: ENST00000597909
  CDS Start-End: 238-591
tagacccggaagcggatggcagggactgaaggtcacaccacagcgcagtctcactctgtccttcaggctgtgagtgcagtctcctgatcttggctcactgcaacctctgtctcctgggttcaagtgattcttgtgcctcagcctaccaagtagctgagatacaggattgacttctaaagactcttggtacctgaggaagaaacccagaagaggaagaggaaagcaaaggagtcggggatggctctttctcagggtctactgacattcagggatgtggccatagaattctctcaggaggagtggaaatgcctggaccctgctcagaggactctatacagagacgtgatgctggagaattataggaacctggtctccctgggattgatttccagagacttatgttacttgaggaagacaccaagaaggcaaagaaaaggagccagggatggctcttcctcagggatacttgactttcagagatgtggctatagagttctctttgctggagtggaaacgcctggaccctgcacagaacgctttatacagggctgtgatgtgggagaactacaggaacctggagtctgtgggtgaggaaaatgttcctccagacatgaagaatctgtccttgtgtatcttggcttttcctggttttgtattctcttttgtgattttgccccatacgtgcttttgatgtacacagctgggattccaggcacgtgccaccatgcccagcatgttattttgtatctttagt

SEQ ID NO: 202130 - DNA, 6448 bp, Homo sapiens
  Payload ID: 19873
  Gene Name: zinc finger protein 320
  Uniprot ID: A2RRD8
  ENST ID: ENST00000595635
  CDS Start-End: 503-2032
cggcccctctttctcaacccagagcaaattgagacgtccgggctggagtgcaatggcgcgatcttggctcaccacaacctccgcctcctgggttcaagtgatctcctgcctcagcctccccagtagccgggattacagtagagacaaggtttcaccatattggccagactgttctctgaactcgacctcaagtgatccacccacctcggcctcccagagtcctgggattacaggctggagggcagttgtgcgatcttgattcacttcaacctctgctctccgggctcaagcaattctcccacctcagcctgagtctcactctgtccttcaggctgtgagtgcagtctcctgatcttggctcactgcaacctctgtctcctgggttcaagtgattcttgtgcctcagcctaccaagtagctgagatacaggattgacttctaaagactcttggtacctgaggaagaaacccagaagaggaagaggaaagcaaaggagtcggggatggctctttctcagggtctactgacattcagggatgtggccatagaattctctcaggaggagtggaaatgcctggaccctgctcagaggactctatacagagacgtgatgctggagaattataggaacctggtctccctggatatctcttccaaatgcatgatgaatacattgtcatcaacagggcaaggcaatacagaagtgatccacacagggacattgcagagacaagcaagttatcacattggagcattttgctcccaggaaattgagaaagacattcatgactttgtgtttcagtggcaagaagatgaaacaaatgaccatgaagcacccatgacagaaataaaaaagttgactagtagtacagaccgatatgatcaaaggcatgctggaaacaagcctattaaaggtcagcttgaatcaagatttcatttgcatttgcgaagacataggagaattcatactggagagaaaccttacaaatgtgaagaatgtgagaaagttttcagttgcaaatcacatcttgaaatacataggataattcatactggagagaaaccatacaaatgtaaggtttgcgacaaggcttttaagcatgattcacacctggcaaaacatactagaattcacaggggagacaaacattacacatgtaatgaatgtggcaaggtttttgatcaaaaagcaacccttgcatgtcatcatagaagtcatactggagagaaaccttataagtgtaatgagtgtggcaagacctttagtcagacatcacaccttgtgtaccatcatagactgcatactggagagaaaccttacaaatgtaatgagtgtggcaagaccttcgctcgaaattcagtcctcgtaattcataaggcagttcatactgcagagaaaccctataagtgtaatgaatgtggcaaggtttttaagcaacgagcaactcttgcaggacatcgtagagttcacactggagagaaaccttacagatgtgaagaatgcgacaaagttttcagtcgcaaatcacatcttgaaagacataggaggattcatactggagagaaaccatacaaatgtaaggtttgtgacaaggctttccggagtgattcacgtcttgcagaacatcagagagttcatactggagagagaccttacacatgtaatgaatgtggcaaggtttttagtacaaaagcgtacctcgcatgtcatcaaaaacttcatactggagagaaactttacgaatgtgaagaatgtgacaaagtttacattcgcaaatcacaccttgaaagacataggaggattcatacaggagagaaacctcacaagtgtggtgattgtggtaaagcctttaattcaccttcacaccttattaggcatcagagaatccatactggacagaaatcttacaaatgtcatcagtgtggcaaggtctttagtctgaggtcactccttgcagaacatcagaaaattccttttggagacaattgtttcaagtgcaatgagtatagcaaaccatcaagcattaattgacatcagagtcaaatcagcattgacctgagtttgagttgacttaacattgatttcaagcattaatcgacattaaactgtttatgttaagaggattgggccaggcgtggtgtctcacacctgtaatcccagcactttgagaggccaagacaggtaggtcacttgaggtcatgaatttgagaccagcctggccaacagacgggagccacttttcccagcctgtatgttcttttatttatttatttatttttaagatggaatcttgctctgtcgcccacgttggagtgcagtgatgtgatctcggttcactgcaacattcacctcccaggttcatgcaattctcctgcctcagtctcctgagtagctgggactacaggtgcgtgccaccatgcccgggtaattttttgtatttttagtagagactgggtttcaccgtgttagctaggatggtctcgatcttctgtccttaaaatccacctgcctccacctgccaaagtgctgagattacaggcgtgagccaccacacctggcctgttttttgtttctttaacaaaaagttatagaaatttctctgggtattgtgttgaatctacatcacattcagttataatcatttagcaatattattccattcaatatggcttgtatctcttatttgcacatgtttttatcactttgatcaatgtttgtagatttgaaggtagaaacttctcaacttttttcatttattcctaagtatttcttactttaagttctttagcaaatgaaagtgtttttttaattttctttttaaattgtttattgttaatgtatggaaattcaactaatttttggtgctgttattctattcttcaaatccactgcatatgttttttagttccagttgcattttggttgactctttgtgattttctacacagaagatcatgtcatctacaaagaaatagttttacttctttctttctgatttggatgagtttgatttcttttgctatttcattgctctagctaggacagccagtattgattgaatagaaggggtgagagcattcttgcatcatgtgagatcctacaggaaaagcattccattttccctgactggttatttctgctgtggtcatttcatggatggtctttgtattgttgaggtaaatttccttctctttctattttgtttaggatttccatgatgactggatgttgaattttgtgaaatgctttttctccatgtattgagatgatgtggttttcatctttcattatgttcaagtggtatatcacattgatttgcttgactatgttgaaccattttgcatcccagaaataagtggcacttgcatatcaacaatcctttttataacctcttgaatacagttcgctagtacaaggggtcttcaggaagttcatggaaaaatacatattatgagaaaattgtgcatgatatcacattttttgcaccaagataaactgatacaaatccgttataacatgtctgaacagggtttggtttgaggcactcagatgggtaagacatgagtttgaaaagagactcaatcaaggcaatgtaaattctgctaaaactgaaacaagaagaaacatcaaatttgcgatgagaccagatgctgtggctcaggcctgtaatcccataattttcagaggctgagacagttgggtcacgtgggccccggtactcaagaccagcctgggcagaatggtgaaaccaccttctctacaaaaaatacataaattagctgggcattgtggcacatgtctgctggttcagcttctgtggagtctgcagtgggaggatggcttgagcctaggagttcgaggctgcagggagccatgatcatgccattgtactccagcatgggtgacagagacagatagtgtatcgaaaaatgaatctggtaaagtttgggtagagggacaatgaaatcattgatgctttatgaaaaggttatggggacgattcccaaaataaatcaccagtttgtaaatggaaaacttattttaagttgggacaagatgatgttgaaagtgatgcacaggacaggtgtggtggctcacacctgtaatcccagcactttgggaggccgaggcaagagcatcacgaggtcaggagatcgagaaaatcctggctaacacggtgaaaccccatctctactaaaaatacaaaaaattagccaggcgtggttgtgggcgcctgtagtcccagctactcaggaggctgaggcaggagaatggcatgaaccgaggaggtggagcttgccatgagcagagatcatgctactgcactccagcctgggtgacagagcgagactccatctcaaaaaaaaaaaaaaaaaaaaaaaaaagaaagtgatgcacagagtggcaggcagaccatccacataagttttataggtacaactgtcaaagacgacactggagaagagccaagctggatctataaggaattgcatatgagatggcacacatattcatgctgtctgaagattcagtcacgttaccatatcaagctgaaaatgtcaccactatctggagagttggacatgttttattgagaatgtattttttttctctggatctgttatgaacacctttgttggcttggttcagtaataaatatgtgagacttttcatttaaaaaaagtcaaatgacttaattctgtattttaaattctgttttgtttgttttgtttttttgagatggagtcttctgaaaattttctcatcttctctaacccggttcatgacagacccttggactttactgttgtggaaaaatctatataaaacagtatcagtgtgtcaaagcattatggctgtcacaagcttgtgaaaggaaaataaaaattactaagccaaagagaaaagtcaatctgggaactgcgtcagacaaacctgccttccattttattcctaaacaagatagttacaaagattttttaaaaagctacatatgcccctcccaaaccgggaacctcaagatctccaccctaaaatagttctgttgaatttcaccctggcgatgtaaactgagagcttatcttcacagatgtgggaaagagcccatccctctgcacacctgagtcaaatgtctatctgattgcttcccttgccctatttatgtaaaaatacagggtccctgagccagcctaaggcataagtgacttatccctcctccctgctcacatataaattgtgtatttagtgaaaggctgatcaaagattcaaagaatgttatttgttatctacctgtgacccagaaggtccccaattccagttattccacctttccagaccggaccaatgtatatatgtactgattgctgtctcgtgtgtctgtaaaatgtgtgaaaccaaactgcagcctcaacaccatggacacacgtcatcaggacctcctgaggttcgtgttaattggccttagactctccctgtccccagacccaggacgcatgtgtttcctttttcttcatttctattaaagatgggtctcattctgttggccaggcatgagagcggtgacaggatcagccctcactgaagcttcaatctcctgggttcaagggatcctcccacctcagcctccaaagttgctaggaccatagccaggtgccaccgcaccgggcaaatttttgtgttcctagtagagatgggctttcaccatgttgcccgagctggtcttgaattccagggctcaagcgatccagccgtattggcctcccaaggtgctgggattacagccatgagccaccatgaccaacgtgtttcttaatttaaaaaaaaaaaaatagaccaggtgctctggctcatgcctgtaatcccagcactttgggaggccaaggtgggcagatcacctgagatcaagtatttgagaacagcctggctaacatggcgaatcctcgttttgaccaaaatatagaaattagcctggtgtggtggcgagtgcctgtaatcccagctattcaggagggtgaggcagaagaatggcttgaattcgggaggcggaggttgcagtgagctgagatcctgcaactgcactctggctgggcaagagcgagactccatctctaaaataaaattaaagtaatataaaaaactgcttctcatgaaagctttggtataatcttacgaggtaacatcattgttttgcaactacggtatgtgttcaaaatgttcttctttgaccccacatttcattagatatatttttaagccattttaaaattgtttttctctgaaatttattgtgtttagtttacattgaggactgcatgctttctagtctgtatcatacattggaaacattttctagtacctgataaatgattttaggttgtttcgatgtgtacttgataaagatatcaaggaactttttctttatgctaacattaaaatttagttgaagta

SEQ ID NO: 202131 - DNA, 4817 bp, Homo sapiens
  Payload ID: 19874
  Gene Name: zinc finger protein 322
  Uniprot ID: Q6U7Q0
  ENST ID: ENST00000415922
  CDS Start-End: 647-1855
gggggtggggctgcgccggcctcttcccagccagcttgaaagggtttgcgtagccggccttgtgggcccttgaagcgctctgttaaagcgctctgtgggcggcctggccccaactcctctagtctaggcgcacgaagggagttgctcctaggtcttgtccgtgccgggttcgcttttctttccttcccgaagcctggcccttagatctactatcgcagagtctgcggccgccaggaagcccagattcgagtgtccggagagtaaccggaagtgctgtccccaggcctaggggcggcgccggcggctgccagggagaggcaagaattgagtgttgtgaatagttctgaactagagaccttttgaaaccaaaaggaagatggtcttgagtctttcttgttacgaatgctatcttctttgagaagtcaaattgtcaggatcaggaatgtatgttttcttccatctggattctagggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaaaagatttttattcatatgcatgagattattcagatagatggtcatatataccagtgccttgaatgcaagcaaaacttctgtgaaaacttagctcttattatgtgtgagagaacccatactggggagaaaccttataaatgtgatatgtgtgagaaaacctttgtccaaagctcagatcttacttcacaccagaggatccacaattacgagaaaccttataaatgtagcaaatgtgagaagagcttttggcatcacttagcgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtgggtgagaatctatgtacatataatatgtatgagaagactgttctcatagttagttgactcatatggtagagaggactttacatgaaatcagtatgaaaatagttttttagatacccagaagcttgttctgggagaagctagggtgggtcagagtagacctgatgggtaactcaggtaaagatgcttttcttttatctgaactacttaatgattgctttacttttactttttaaaaaattcagaaatccaataaaggaaaggacggtaaccttatgatagaaggtgtggcatgtgttactgttgggggaaaggagtatattgactttgccttggttgatatttttatgcttgtctaggatgggactagagtgttgatagtaacatggcagccttttgctggcagtgaaatgaacttaagaagctagggagtagctatcctagatcaaaactctcctaatagtttttcctttgcaggaccaatcttataaagaaacagcatactcagctttttacttagtgtcagttgaggcatactctcaaaagttttttcccctaaaatatctttcaagttattactggtatttgaaatttcaagtttagaaattcatttctttttaactcaaagtgcaaatttcatataatgattatgatggttttagtgtccatatttttgtggcttcacttatcatctctttcagcagtagctacccacagtcagctcctagtaaaatggctacaggaaaactgaaagaaaagtttaagcctgagtaggcatagagtaaaaaatgcataatgatgcattattaatataagagtaaggctttttttattttgagtatcctaactccaaacctagtgttcttttcactccattatcctgctgtttatagcaaatcaagacccataatgatacgtctttcatttatttcagttctgccaaggaaagagaaaataccttttaatcccagggaaaggattgcaatcaccacattataaggtatatggcgtggaatgcagaattctaaatactagaagggaaaagtagttggcagattcatcagaggcttaaggataagtacttgtttccaatttaaaagtataattaggattgtctttaatgttctctagaaatactataattaatctagagatctatcaatggtcacatctcagtttttttcttccctgagattcaaagacgtgtaataccaatacttcagattcctatagtatttgggactttgtagactagtgaatagatactttgttgctagtccaaatcctctgattttggtttgatttgtcctagcagatccctgaacttcagagagtattgccatttggattcatggagttggcgaactgctacactgctaccttgtgtatggctctaagctttgatcctaatgactggttgatgatcatgataatattagggccagtgaatatagctcatagtgataataaggattctagggtatttttttttcttttagaaaaagatcctggaagtttatttgatctgacatgtttttgtaatatttagaaatagctcttgtatcataaaaagttgcccagtataagacacacaagatgtattttttttctctggtgaaaatcatgcctatcactagtatatgtttgacatttgtagtatacttaaaatagtattgggtgtgaggcatggtggtgatgaaaagtagtccttacggctacttgttagtcattagagagaacatggagaaggggtcaaagttggtatcattaacagggcaatgacttgacccttctttcaactgatcttactggtagttgtctctagtttttaagtaaattaatgatggaccatcccccaaacagagaactatgggggtatgaaacaaggctgaaggcttttaaccatgggagaaaaaggtgttggtattattcatatagcataacctgaggttggagaggaccacttgggagcctgtaaccaaaactagaaggtaacttctgggatggacggaggttcccttgaagcagtgccaacctaaatctacctcaggtaagtagttagattaactttttcaagatttcagaccaaacaagacaacttgtattcagttgatgtattcctatgctttaatgtttttgtttgcccttaattattaaataaacatttgttctgaaaaactcca

SEQ ID NO: 202132 - DNA, 2675 bp, Homo sapiens
  Payload ID: 19874
  Gene Name: zinc finger protein 322
  Uniprot ID: Q6U7Q0
  ENST ID: ENST00000471278
  CDS Start-End: 413-1621
attcctcctgtttaactgaaattttgtatcctttgaccaatttcttcccaaccctgctatgtctcagcctctggtaaccaccattttaccatctgtttctatcagttagactgttttatactccatatcattatctctctattccagtattatgttgaaaagcagtgaatgctatcttctttgagaagtcaaattgtcaggatcaggaatgtatgttttcttccatctggattctagggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaaaagatttttattcatatgcatgagattattcagatagatggtcatatataccagtgccttgaatgcaagcaaaacttctgtgaaaacttagctcttattatgtgtgagagaacccatactggggagaaaccttataaatgtgatatgtgtgagaaaacctttgtccaaagctcagatcttacttcacaccagaggatccacaattacgagaaaccttataaatgtagcaaatgtgagaagagcttttggcatcacttagcgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtgggtgagaatctatgtacatataatatgtatgagaagactgttctcatagttagttgactcatatggtagagaggactttacatgaaatcagtatgaaaatagttttttagatacccagaagcttgttctgggagaagctagggtgggtcagagtagacctgatgggtaactcaggtaaagatgcttttcttttatctgaactacttaatgattgctttacttttactttttaaaaaattcagaaatccaataaaggaaaggacggtaacctt

SEQ ID NO: 202133 - DNA, 587 bp, Homo sapiens
  Payload ID: 19874
  Gene Name: zinc finger protein 322
  ENST ID: ENST00000480036
  CDS Start-End: 510-587
ccttgaagcgctctgttaaagcgctctgtgggcggcctggccccaactcctctagtctaggcgcacgaagggagttgctcctaggtcttgtccgtgccgggttcgcttttctttccttcccgaagcctggcccttagatctactatcgcagagtctgcggccgccaggaagcccagattcgagtgtccggagagtaaccggaagtgctgtccccaggcctaggggcggcgccggcggctgccagggagaggcaagaattgagtgttgtgaatagttctgaactagagaccttttgaaaccaaaaggaagatggtcttgagtctttcttgttacgggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaa

SEQ ID NO: 202134 - DNA, 4718 bp, Homo sapiens
  Payload ID: 19874
  Gene Name: zinc finger protein 322
  Uniprot ID: Q6U7Q0
  ENST ID: ENST00000456172
  CDS Start-End: 558-1766
gggggtggggctgcgccggcctcttcccagccagcttgaaagggtttgcgtagccggccttgtgggcccttgaagcgctctgttaaagcgctctgtgggcggcctggccccaactcctctagtctaggcgcacgaagggagttgctcctaggtcttgtccgtgccgggttcgcttttctttccttcccgaagcctggcccttagatctactatcgcagagtctgcggccgccaggaagcccagattcgagtgtccggagagtaaccggaagtgctgtccccaggcctaggggcggcgccggcggctgccaggaatgctatcttctttgagaagtcaaattgtcaggatcaggaatgtatgttttcttccatctggattctagggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaaaagatttttattcatatgcatgagattattcagatagatggtcatatataccagtgccttgaatgcaagcaaaacttctgtgaaaacttagctcttattatgtgtgagagaacccatactggggagaaaccttataaatgtgatatgtgtgagaaaacctttgtccaaagctcagatcttacttcacaccagaggatccacaattacgagaaaccttataaatgtagcaaatgtgagaagagcttttggcatcacttagcgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtgggtgagaatctatgtacatataatatgtatgagaagactgttctcatagttagttgactcatatggtagagaggactttacatgaaatcagtatgaaaatagttttttagatacccagaagcttgttctgggagaagctagggtgggtcagagtagacctgatgggtaactcaggtaaagatgcttttcttttatctgaactacttaatgattgctttacttttactttttaaaaaattcagaaatccaataaaggaaaggacggtaaccttatgatagaaggtgtggcatgtgttactgttgggggaaaggagtatattgactttgccttggttgatatttttatgcttgtctaggatgggactagagtgttgatagtaacatggcagccttttgctggcagtgaaatgaacttaagaagctagggagtagctatcctagatcaaaactctcctaatagtttttcctttgcaggaccaatcttataaagaaacagcatactcagctttttacttagtgtcagttgaggcatactctcaaaagttttttcccctaaaatatctttcaagttattactggtatttgaaatttcaagtttagaaattcatttctttttaactcaaagtgcaaatttcatataatgattatgatggttttagtgtccatatttttgtggcttcacttatcatctctttcagcagtagctacccacagtcagctcctagtaaaatggctacaggaaaactgaaagaaaagtttaagcctgagtaggcatagagtaaaaaatgcataatgatgcattattaatataagagtaaggctttttttattttgagtatcctaactccaaacctagtgttcttttcactccattatcctgctgtttatagcaaatcaagacccataatgatacgtctttcatttatttcagttctgccaaggaaagagaaaataccttttaatcccagggaaaggattgcaatcaccacattataaggtatatggcgtggaatgcagaattctaaatactagaagggaaaagtagttggcagattcatcagaggcttaaggataagtacttgtttccaatttaaaagtataattaggattgtctttaatgttctctagaaatactataattaatctagagatctatcaatggtcacatctcagtttttttcttccctgagattcaaagacgtgtaataccaatacttcagattcctatagtatttgggactttgtagactagtgaatagatactttgttgctagtccaaatcctctgattttggtttgatttgtcctagcagatccctgaacttcagagagtattgccatttggattcatggagttggcgaactgctacactgctaccttgtgtatggctctaagctttgatcctaatgactggttgatgatcatgataatattagggccagtgaatatagctcatagtgataataaggattctagggtatttttttttcttttagaaaaagatcctggaagtttatttgatctgacatgtttttgtaatatttagaaatagctcttgtatcataaaaagttgcccagtataagacacacaagatgtattttttttctctggtgaaaatcatgcctatcactagtatatgtttgacatttgtagtatacttaaaatagtattgggtgtgaggcatggtggtgatgaaaagtagtccttacggctacttgttagtcattagagagaacatggagaaggggtcaaagttggtatcattaacagggcaatgacttgacccttctttcaactgatcttactggtagttgtctctagtttttaagtaaattaatgatggaccatcccccaaacagagaactatgggggtatgaaacaaggctgaaggcttttaaccatgggagaaaaaggtgttggtattattcatatagcataacctgaggttggagaggaccacttgggagcctgtaaccaaaactagaaggtaacttctgggatggacggaggttcccttgaagcagtgccaacctaaatctacctcaggtaagtagttagattaactttttcaagatttcagaccaaacaagacaacttgtattcagttgatgtattcctatgctttaatgtttttgtttgcccttaattattaaataaacatttgttctg

SEQ ID NO: 202135 - DNA, 4882 bp, Homo sapiens
  Payload ID: 19874
  Gene Name: zinc finger protein 322
  Uniprot ID: Q6U7Q0
  ENST ID: ENST00000622479
  CDS Start-End: 722-1930
gggggtggggctgcgccggcctcttcccagccagcttgaaagggtttgcgtagccggccttgtgggcccttgaagcgctctgttaaagcgctctgtgggcggcctggccccaactcctctagtctaggcgcacgaagggagttgctcctaggtcttgtccgtgccgggttcgcttttctttccttcccgaagcctggcccttagatctactatcgcagagtctgcggccgccaggaagcccagattcgagtgtccggagagtaaccggaagtgctgtccccaggcctaggggcggcgccggcggctgccaggagctggtcggaactgatggctaccagtggcaggtacttcctgcaggagaaacagtgtaagcaaagatgggaagaggagaggcaagaattgagtgttgtgaatagttctgaactagagaccttttgaaaccaaaaggaagatggtcttgagtctttcttgttacgaatgctatcttctttgagaagtcaaattgtcaggatcaggaatgtatgttttcttccatctggattctagggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaaaagatttttattcatatgcatgagattattcagatagatggtcatatataccagtgccttgaatgcaagcaaaacttctgtgaaaacttagctcttattatgtgtgagagaacccatactggggagaaaccttataaatgtgatatgtgtgagaaaacctttgtccaaagctcagatcttacttcacaccagaggatccacaattacgagaaaccttataaatgtagcaaatgtgagaagagcttttggcatcacttagcgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtgggtgagaatctatgtacatataatatgtatgagaagactgttctcatagttagttgactcatatggtagagaggactttacatgaaatcagtatgaaaatagttttttagatacccagaagcttgttctgggagaagctagggtgggtcagagtagacctgatgggtaactcaggtaaagatgcttttcttttatctgaactacttaatgattgctttacttttactttttaaaaaattcagaaatccaataaaggaaaggacggtaaccttatgatagaaggtgtggcatgtgttactgttgggggaaaggagtatattgactttgccttggttgatatttttatgcttgtctaggatgggactagagtgttgatagtaacatggcagccttttgctggcagtgaaatgaacttaagaagctagggagtagctatcctagatcaaaactctcctaatagtttttcctttgcaggaccaatcttataaagaaacagcatactcagctttttacttagtgtcagttgaggcatactctcaaaagttttttcccctaaaatatctttcaagttattactggtatttgaaatttcaagtttagaaattcatttctttttaactcaaagtgcaaatttcatataatgattatgatggttttagtgtccatatttttgtggcttcacttatcatctctttcagcagtagctacccacagtcagctcctagtaaaatggctacaggaaaactgaaagaaaagtttaagcctgagtaggcatagagtaaaaaatgcataatgatgcattattaatataagagtaaggctttttttattttgagtatcctaactccaaacctagtgttcttttcactccattatcctgctgtttatagcaaatcaagacccataatgatacgtctttcatttatttcagttctgccaaggaaagagaaaataccttttaatcccagggaaaggattgcaatcaccacattataaggtatatggcgtggaatgcagaattctaaatactagaagggaaaagtagttggcagattcatcagaggcttaaggataagtacttgtttccaatttaaaagtataattaggattgtctttaatgttctctagaaatactataattaatctagagatctatcaatggtcacatctcagtttttttcttccctgagattcaaagacgtgtaataccaatacttcagattcctatagtatttgggactttgtagactagtgaatagatactttgttgctagtccaaatcctctgattttggtttgatttgtcctagcagatccctgaacttcagagagtattgccatttggattcatggagttggcgaactgctacactgctaccttgtgtatggctctaagctttgatcctaatgactggttgatgatcatgataatattagggccagtgaatatagctcatagtgataataaggattctagggtatttttttttcttttagaaaaagatcctggaagtttatttgatctgacatgtttttgtaatatttagaaatagctcttgtatcataaaaagttgcccagtataagacacacaagatgtattttttttctctggtgaaaatcatgcctatcactagtatatgtttgacatttgtagtatacttaaaatagtattgggtgtgaggcatggtggtgatgaaaagtagtccttacggctacttgttagtcattagagagaacatggagaaggggtcaaagttggtatcattaacagggcaatgacttgacccttctttcaactgatcttactggtagttgtctctagtttttaagtaaattaatgatggaccatcccccaaacagagaactatgggggtatgaaacaaggctgaaggcttttaaccatgggagaaaaaggtgttggtattattcatatagcataacctgaggttggagaggaccacttgggagcctgtaaccaaaactagaaggtaacttctgggatggacggaggttcccttgaagcagtgccaacctaaatctacctcaggtaagtagttagattaactttttcaagatttcagaccaaacaagacaacttgtattcagttgatgtattcctatgctttaatgtttttgtttgcccttaattattaaataaacatttgttctg

SEQ ID NO: 202136 - DNA, 4737 bp, Homo sapiens
  Payload ID: 19874
  Gene Name: zinc finger protein 322
  Uniprot ID: Q6U7Q0
  ENST ID: ENST00000607204
  CDS Start-End: 577-1785
gggggtggggctgcgccggcctcttcccagccagcttgaaagggtttgcgtagccggccttgtgggcccttgaagcgctctgttaaagcgctctgtgggcggcctggccccaactcctctagtctaggcgcacgaagggagttgctcctaggtcttgtccgtgccgggttcgcttttctttccttcccgaagcctggcccttagatctactatcgcagagtctgcggccgccaggaagcccagattcgagtgtccggagagtaaccggaagtgctgtccccaggcctaggggcggcgccggcggctgccagggagaggcaagaattgagtgttgtgaatagttctgaactagagaccttttgaaaccaaaaggaagatggtcttgagtctttcttgttacgggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaaaagatttttattcatatgcatgagattattcagatagatggtcatatataccagtgccttgaatgcaagcaaaacttctgtgaaaacttagctcttattatgtgtgagagaacccatactggggagaaaccttataaatgtgatatgtgtgagaaaacctttgtccaaagctcagatcttacttcacaccagaggatccacaattacgagaaaccttataaatgtagcaaatgtgagaagagcttttggcatcacttagcgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtgggtgagaatctatgtacatataatatgtatgagaagactgttctcatagttagttgactcatatggtagagaggactttacatgaaatcagtatgaaaatagttttttagatacccagaagcttgttctgggagaagctagggtgggtcagagtagacctgatgggtaactcaggtaaagatgcttttcttttatctgaactacttaatgattgctttacttttactttttaaaaaattcagaaatccaataaaggaaaggacggtaaccttatgatagaaggtgtggcatgtgttactgttgggggaaaggagtatattgactttgccttggttgatatttttatgcttgtctaggatgggactagagtgttgatagtaacatggcagccttttgctggcagtgaaatgaacttaagaagctagggagtagctatcctagatcaaaactctcctaatagtttttcctttgcaggaccaatcttataaagaaacagcatactcagctttttacttagtgtcagttgaggcatactctcaaaagttttttcccctaaaatatctttcaagttattactggtatttgaaatttcaagtttagaaattcatttctttttaactcaaagtgcaaatttcatataatgattatgatggttttagtgtccatatttttgtggcttcacttatcatctctttcagcagtagctacccacagtcagctcctagtaaaatggctacaggaaaactgaaagaaaagtttaagcctgagtaggcatagagtaaaaaatgcataatgatgcattattaatataagagtaaggctttttttattttgagtatcctaactccaaacctagtgttcttttcactccattatcctgctgtttatagcaaatcaagacccataatgatacgtctttcatttatttcagttctgccaaggaaagagaaaataccttttaatcccagggaaaggattgcaatcaccacattataaggtatatggcgtggaatgcagaattctaaatactagaagggaaaagtagttggcagattcatcagaggcttaaggataagtacttgtttccaatttaaaagtataattaggattgtctttaatgttctctagaaatactataattaatctagagatctatcaatggtcacatctcagtttttttcttccctgagattcaaagacgtgtaataccaatacttcagattcctatagtatttgggactttgtagactagtgaatagatactttgttgctagtccaaatcctctgattttggtttgatttgtcctagcagatccctgaacttcagagagtattgccatttggattcatggagttggcgaactgctacactgctaccttgtgtatggctctaagctttgatcctaatgactggttgatgatcatgataatattagggccagtgaatatagctcatagtgataataaggattctagggtatttttttttcttttagaaaaagatcctggaagtttatttgatctgacatgtttttgtaatatttagaaatagctcttgtatcataaaaagttgcccagtataagacacacaagatgtattttttttctctggtgaaaatcatgcctatcactagtatatgtttgacatttgtagtatacttaaaatagtattgggtgtgaggcatggtggtgatgaaaagtagtccttacggctacttgttagtcattagagagaacatggagaaggggtcaaagttggtatcattaacagggcaatgacttgacccttctttcaactgatcttactggtagttgtctctagtttttaagtaaattaatgatggaccatcccccaaacagagaactatgggggtatgaaacaaggctgaaggcttttaaccatgggagaaaaaggtgttggtattattcatatagcataacctgaggttggagaggaccacttgggagcctgtaaccaaaactagaaggtaacttctgggatggacggaggttcccttgaagcagtgccaacctaaatctacctcaggtaagtagttagattaactttttcaagatttcagaccaaacaagacaacttgtattcagttgatgtattcctatgctttaatgtttttgtttgcccttaattattaaataaacatttgttctg

SEQ ID NO: 202137 - DNA, 3000 bp, Homo sapiens
  Payload ID: 19875
  Gene Name: zinc finger protein 324
  Uniprot ID: O75467
  ENST ID: ENST00000196482
  CDS Start-End: 95-1756
caggccacaccggtggtctgggctggggaccgcgggtcgggtccggtttccagggggttcctggtgctcgaggctggcggcgaggaaggaccagatggcctttgaggatgtggctgtgtacttctcccaggaggagtgggggctcctggacacagcccagagggccctgtaccgccgcgtgatgctagacaacttcgcacttgtggcctcgctgggactctccacctctcgacctcgtgtggtcatccaactggagcgtggcgaggagccctgggttcccagtggaacggacacaaccctgtccaggaccacctacaggaggcgcaaccctggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagagaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacaggttgcagccctggccttctgtgaatcccttccacagctaaagggcatatgtcctctgcagatccacagcagagaaaaagtcccgtgcttgctagtcagggacaagggaggccctttggctgtgatttcatttgcacgtggggacaggatttgccagttcacccacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattc

SEQ ID NO: 202138 - DNA, 1006 bp, Homo sapiens
  Payload ID: 19875
  Gene Name: zinc finger protein 324
  ENST ID: ENST00000535298
  CDS Start-End: 146-1006
aaccgaagggctggacttccggcggtgggactgtcacttcgccgcccgcgtcaggccacaccggtggtctgggctggggaccgcgggtcgggtccggtttccagggggttcctggtgctcgaggctggcggcgaggaaggaccagatggcctttgaggatgtggctgtgtacttctcccaggaggagtgggggctcctggacacagcccagagggccctgtaccgccgcgtgatgctagacaacttcgcacttgtggcctcgctgggactctccacctctcgacctcgtgtggtcatccaactggagcgtggcgaggagccctgggttcccagtggaacggacacaaccctgtccaggaccacctacaggaggcgcaaccctggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagagaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccgtgtgcggcaaggccttccggcatag

SEQ ID NO: 202139 - DNA, 5653 bp, Homo sapiens
  Payload ID: 19875
  Gene Name: zinc finger protein 324
  Uniprot ID: O75467
  ENST ID: ENST00000536459
  CDS Start-End: 710-2371
tggacttccggcggtgggactgtcacttcgccgcccgcgtcaggccacaccggtggtctgggctggggaccgcgggtcgggtccggtttccagggggttcctggtgctcgaggctggcggcgaggaaggtactggctgagggcccgcgtcgggcccgccctgcgcacgcgtcgtgatcaagggcgccggccgccggccgcgcccccaagcctctgtttctcagagtgcgtcgtgggcgtccaggggactgtcgggccgcggcgggagccatgcgctctcccaccgtgcggcagcccaggaggctgcgcgctgggcgttccacgtccatgatggccggggagactgaggcgcggggcggccccgggacgctgctggcggggaaaggctgggtggtccacgcctttcttccctcccagctgcgggttccgctggcggcggtggcgctgacaagcccgcgtcggggaagcaggggagtccctgctcacacagaccgcgccctcacggagggaggccgcttcctagacctcgcctagtcgtctttcctctccctgccctgggggggttgcgggggtcagtgcaaactcctgcgtccagggcactggtgagctcccgagttcgggcagccagggggctgaggtcccgaaggaggctccgaggggagagtcctgcgtgtgcaaaacctgggaggggagccgaagcccaggaccagatggcctttgaggatgtggctgtgtacttctcccaggaggagtgggggctcctggacacagcccagagggccctgtaccgccgcgtgatgctagacaacttcgcacttgtggcctcgctgggactctccacctctcgacctcgtgtggtcatccaactggagcgtggcgaggagccctgggttcccagtggaacggacacaaccctgtccaggaccacctacaggaggcgcaaccctggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagagaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacaggttgcagccctggccttctgtgaatcccttccacagctaaagggcatatgtcctctgcagatccacagcagagaaaaagtcccgtgcttgctagtcagggacaagggaggccctttggctgtgatttcatttgcacgtggggacaggatttgccagttcacccacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattcatgttctccttaatggaaaaaaaaaaaaaaagactaccatctgcaactcagagtaggtgttgcagtttcctgtacagcagtttggacctccagagcacagcctcttgtccctactccagagcatggttcagtcttaatagcagttcaagagcttctctgataaaggtttctttttaaacatttgtgtgaacggtagcaacctgacacctatttcaccctcatacaatgcagatggtattgaacataccctgacatgccatcagcgtttgtcatcatcacagaagttcctggacttggcttcaacctgggtaccctcaagaggccacagagtagagatacagcctgtctgcagcccagggagggagtgggatacctgtatccttttcagggtcagaggtgggttggggtagccaggagctggatgaactgggatagagtggggctgtctggagcagcagccctgctagatgagtcctggtggatcctggcaatgggaggatggtaggtggagaaaccaaggcagggctgtgttccttctgctgctgagatagagggtgtggccatgtgtgatgaccctgcaaggttgactccaaccagtgggcactccatcccatggcttccaaaatcctgcagctatcctgccctatacacaaagagcccagatccaggccccacacacttgatattggggccagactcttccacctgtgaaacctcacaggttcctgcagggagtggagacacacagaacctagctcccctggagcctgcaagacttgggccaccagaatcccagtaggtccctgaaccattgtcccccagtaagtctgcagagctgtgaaatgcagacaataacccttccctgcctgaaagagcacttttctggggagcccatgggagtcaggagcaaaagcatctgtcaaacaagtagatacccagagagtcacgtgaaatcatttctatgcctctgacagacgcttcttgagcgaagtttctgccctgagcccgcctgaccccttaggctgggctcagtaccctaccttgtcttcccaccagccgcctccctccatcaagttcctttccacgtctgcttgtgcccctgttgtccctcagtttgtccaccctcctccaatcttcccctccccaaacccatgactgatcagtggcccccaacctaggctcccacctccatgcaggtcttggcccctcggctgacctccctccaacctccccctctgctcttaattttgaataggtagtgactgtaaaagtatccctgggcttctatgtcaaaaggtcagactgaacacatgcatctcactgggctcagaaatccactgaaaccacagaggggagtatttaaaacacataacccacaagtatgaggatggtgacagaggagtcaggagcaatggcattcctaagctagaagtgggtgagagctgtcactaagttagggaaggcaaaatactacgtggcgacttggcgaagaggagagagttcccaccaggctgactccagaaccgcagaaggctgagaaccagcagcccagagacgggagacctatatcaaagctgcctggggaacaactactgaagaagcccttaacgccccagtgctctccccacatggtggagggtgaaagtttttgtttttttttccttctgggactctgcatagtcccagagaaaaggcctaagcacctcatccccaaaaacaacctgaggaggccgttggaaagctccgagttgacaagtctcatccacgcacatgctcggtgcttccaatcggtgatcaagaccactgctcttcatccagagcaggcagcagggattcccaggtatccaaagaaaccaaaacaggcggtgtaatttaggactgactaagtaatggctcggccacttttaagtgtggaagcaaaactgaccccacagatttagaaaactgtaacactgcttattgggagaaactagtgtcaccctggctagttctgctccccaaattcaaaggtaaataaacggttgagcatgtccgatca

SEQ ID NO: 202140 - DNA, 2330 bp, Homo sapiens
  Payload ID: 19875
  Gene Name: zinc finger protein 324
  ENST ID: ENST00000593925
  CDS Start-End: 1-1237
ctactgggagaggctcctgctaggctcaggcagtgggcaagccagcgtcagcctgcgactgacctccccgcttaggcctcccgagggcgtccggcttagagaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattcatgttctccttaatgg

SEQ ID NO: 202141 - DNA, 2996 bp, Homo sapiens
  Payload ID: 19876
  Gene Name: zinc finger protein 324B
  Uniprot ID: Q6AW86
  ENST ID: ENST00000336614
  CDS Start-End: 108-1742
acttccggcgttgggactgtcacttggctgctcgcgtcaggccacaccggtggtctgggctgtggcgcgcgggtcggggcccgaggcgggcggccaggaaggacctgatgaccttcgaggatgtggccgtgtacttctcccaggaggagtgggggctcctggacacagcgcagagggccctgtaccgccacgtgatgctggaaaacttcacacttgtgacctcacttggactctctacctcccgacctcgtgtggtcattcaacttgagcgtggcgaggagccctgggttcccagtggaaaggacatgaccctggccaggaacacctacgggaggctcaactctggttcctggagtttgacagaggatagagatgtttctggagaatggccacgagctttcccagataccccacctgggatgactactagcgtcttcccagttgccgatgcctgccacagtgtaaaaagcctgcagcgacaaccgggtgcctccccatctcaggagagaaaacccacgggggtgtcggtgatctactgggagaggctcctgctaggctcgcgcagtgaccaggccagcatcagcctgcgactgacctccccactcaggccccccaagagcagccggcccagggaaaagaccttcacagagtaccgggtgcctgggaggcagcccaggacgcctgagcggcagaagccatgtgcacaggaggtccctgggagagccttcgggaatgcctcggacctgaaggccgccagtggtggcagggatcgcagaatgggcgcagcttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcacccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtatgcgcgctctgcggtgctgccttcagccagggctcctcgctctttttgcaccagcgcgtgcacacaggcgagaagcccttcgcctgcgcccagtgcggccgctcctttagccgcagctccaacctcacccagcaccagctcctgcacacgggcgagcggcccttccgctgcgtggactgtggcaagggtttcgccaagggcgccgtgctgctcagccaccggcgcattcacacgggcgagaagcccttcgtgtgcacgcagtgtggccgcgccttccgtgagcgccctgccctcttgcaccaccagaggatccacaccacagagaagaccaatgccgcagcaccagactgcaccccggggccaggtttccttcagggacatcatcggaaggtgcgccggggagggaagccaagcccagtcctgaagccagcgaaggtctgaggtcacaggtcgcagcccaaccctttcttggccttctgtgaatcccttccacagctaaagggtccgagtgctcttcagatccacgatggggaaaagctctgtgcctgagagtcagggacgagggagaccctttggctgtggttccatttgcaggtggggacaggatttgccagtttagtcatagctcacacctccatcctcaaagaggtaacactgcagaaacatcagagggaggacatgtcagctggaactctggtggggctgaggctgtagttggggccataggacgccgacaaaggcagcgctgcatggtggtgctacttcatgtgttatgagagtggatgctgaggtgagggggatgcggacatggggtaggatgacctagagaaacttatgatgtctgcacacaaactggccgctagacggacgctgaggacattttccccctgaggcctctattcaaggcttcctgggggccatctcagcaaacaggagactacaggggactggggatcagggtgtggcctgtgagtgtcagcctcctcctcggaaaaagaaaagctttgggtcaactcagcatcatgtttgcagatgctgacagacgggatcctaatgagagtcaatgtgtgctcactgccagctcctgggctgtgctctggtcagccaggtgtgagggcctggcctggggtcacacagctgactcaggagaggaatgcccatggttctcagcattggaaggacaaacctaggatgatggctttccagtggcactcgttcaggttttcgtccaagtctcagcttggccaaggcctgtcgctcactcatttacaaaagtcgatgtgaggaggagcctttacacctgtggagacagtgatagctttggagcagataaggtggagctgctcatttttgctggatttggtggccgatccccgcccccacccccaccccctccatctcacctttcccttgttatgcctcctcaattggaggctggacagagagctgaataggaaggacttgccattacctaaggccatgtgtgacagcctcctgaggacctccccaacccagtgtgatgggcctgcatggcagagacaaaagggtagactgggggtcatttgcttcctgtggccttaagcctactaggccccatccttacctgagacctcacctccaagaaattaatggtcttttcaatggagaaaaaaaaagactagtatttgcaacttcaaatagatgtagtttccttta

SEQ ID NO: 202142 - DNA, 2368 bp, Homo sapiens
  Payload ID: 19876
  Gene Name: zinc finger protein 324B
  Uniprot ID: Q6AW86
  ENST ID: ENST00000545523
  CDS Start-End: 181-1815
gcgttgggactgtcacttggctgctcgcgtcaggccacaccggtggtctgggctgtggcgcgcgggtcggggcccgaggcgggcggccaggaaggttcttggggctgcacccctatgacgactggtggggatcatccagtccctcaggctggatgagcagcctggaaatgtcaggacctgatgaccttcgaggatgtggccgtgtacttctcccaggaggagtgggggctcctggacacagcgcagagggccctgtaccgccacgtgatgctggaaaacttcacacttgtgacctcacttggactctctacctcccgacctcgtgtggtcattcaacttgagcgtggcgaggagccctgggttcccagtggaaaggacatgaccctggccaggaacacctacgggaggctcaactctggttcctggagtttgacagaggatagagatgtttctggagaatggccacgagctttcccagataccccacctgggatgactactagcgtcttcccagttgccgatgcctgccacagtgtaaaaagcctgcagcgacaaccgggtgcctccccatctcaggagagaaaacccacgggggtgtcggtgatctactgggagaggctcctgctaggctcgcgcagtgaccaggccagcatcagcctgcgactgacctccccactcaggccccccaagagcagccggcccagggaaaagaccttcacagagtaccgggtgcctgggaggcagcccaggacgcctgagcggcagaagccatgtgcacaggaggtccctgggagagccttcgggaatgcctcggacctgaaggccgccagtggtggcagggatcgcagaatgggcgcagcttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcacccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtatgcgcgctctgcggtgctgccttcagccagggctcctcgctctttttgcaccagcgcgtgcacacaggcgagaagcccttcgcctgcgcccagtgcggccgctcctttagccgcagctccaacctcacccagcaccagctcctgcacacgggcgagcggcccttccgctgcgtggactgtggcaagggtttcgccaagggcgccgtgctgctcagccaccggcgcattcacacgggcgagaagcccttcgtgtgcacgcagtgtggccgcgccttccgtgagcgccctgccctcttgcaccaccagaggatccacaccacagagaagaccaatgccgcagcaccagactgcaccccggggccaggtttccttcagggacatcatcggaaggtgcgccggggagggaagccaagcccagtcctgaagccagcgaaggtctgaggtcacaggtcgcagcccaaccctttcttggccttctgtgaatcccttccacagctaaagggtccgagtgctcttcagatccacgatggggaaaagctctgtgcctgagagtcagggacgagggagaccctttggctgtggttccatttgcaggtggggacaggatttgccagtttagtcatagctcacacctccatcctcaaagaggtaacactgcagaaacatcagagggaggacatgtcagctggaactctggtggggctgaggctgtagttggggccataggacgccgacaaaggcagcgctgcatggtggtgctacttcatgtgttatgagagtggatgctgaggtgagggggatgcggacatggggtaggatgacctagagaaacttatgatgtctgcacacaaactggccgctagacggacgctgaggacattttccccctgaggcctctattcaaggcttcctgggggccatctcagcaaacaggagactacaggggactggggatcagggtgtggcctgtgagtgtcagcctcctcctcggaaa

SEQ ID NO: 202143 - DNA, 564 bp, Homo sapiens
  Payload ID: 19876
  Gene Name: zinc finger protein 324B
  ENST ID: ENST00000594214
  CDS Start-End: 65-457
acaccggtggtctgggctgtggcgcgcgggtcggggcccgaggcgggcggccaggaaggacctgatgaccttcgaggatgtggccgtgtacttctcccaggaggagtgggggctcctggacacagcgcagagggccctgtaccgccacgtgatgctggaaaacttcacacttgtgacctcacttggactctctacctcccgacctcgtgtggtcattcaacttgagcgtggcgaggagccctgggttcccagtggaaaggacatgaccctggccaggaacacctacgggaggctcaactctggtgagtgggagctcaggtggggtgaactaaggaccaacctgtggccaagcccatgtccctgcttttctgactctggaaacacatcctcctctcctgcctcctacctgactcccttctcttccatcatcagcctctcctggaggctgctgccttagtaggtgcccttgaagggagagctccaagggcacaggagctgggttcacacagaagggcctaccttcagctgggctgtgtggccttgaaccctccacaactagcagcc

SEQ ID NO: 202144 - DNA, 979 bp, Homo sapiens
  Payload ID: 19876
  Gene Name: zinc finger protein 324B
  ENST ID: ENST00000598244
  CDS Start-End: 742-979
acttggctgctcgcgtcaggccacaccggtggtctgggctgtggcgcgcgggtcggggcccgaggcgggcggccaggaagggcactggtgagctcccgacttccggcagccagggggctgaggtcccgaaggaggctccgaggggagagtcctgcgtgtgcaaaacctgggaggggagccgaagcccagatgcttctgggactgagcgctctcgatgtggagctggagtagaggggatgtgtgcggctgcagtagcaggcgagggagtgggctttatctcgagggcgtcgggagacatagaagttttgaacagaatcaggacatcctctgagttgggactttaaaacggttccaccgtttgttgcgtggagaacagacatgcaggggtgtcggcatgaagggaagaaccgactgccacagtctgggcagcagtggaggtgggcgaccaggtgaattctggtggatctgcggatgcatcaggtgtgggctgtttgaagaactaagtaccccatgttgttcagcctgagcgcctggaagaagagagctgctgtagatagaaaggagaattgaaaggaaagcaggtttccttcaggggaaagatcaagagtctgggatgtcccaggttggtcatgtcactggacctgacgttgttggtgtcctgggctgaggacagggcctataaactggactgaagaaggcgatgagcagtcaggcgtgcggagttacagcttgagggacctgatgaccttcgaggatgtggccgtgtacttctcccaggaggagtgggggctcctggacacagcgcagagggccctgtaccgccacgtgatgctggaaaacttcacacttgtgacctcacttggactctctacctcccgacctcgtgtggtcattcaacttgagcgtggcgaggagccctgggttcccagtggaaaggacatgaccctggccaggaacacctacgggaggctcaactctg

SEQ ID NO: 202145 - DNA, 546 bp, Homo sapiens
  Payload ID: 19876
  Gene Name: zinc finger protein 324B
  ENST ID: ENST00000599194
  CDS Start-End: 132-546
actgtcacttggctgctcgcgtcaggccacaccggtggtctgggctgtggcgcgcgggtcggggcccgaggcgggcggccaggaaggtacggaccacgagcagccggccgcgcccccaagcctcggacctgatgaccttcgaggatgtggccgtgtacttctcccaggaggagtgggggctcctggacacagcgcagagggccctgtaccgccacgtgatgctggaaaacttcacacttgtgacctcacttggactctctacctcccgacctcgtgtggtcattcaacttgagcgtggcgaggagccctgggttcccagtggaaaggacatgaccctggccaggaacacctacgggaggctcaactctggttcctggagtttgacagaggatagagatgtttctggagaatggccacgagctttcccagataccccacctgggatgactactagcgtcttcccagttgccgatgcctgccacagtgtaaaaagcctgcagcgacaaccgggtgcctccccatctcaggagagaaaacccacggggg

SEQ ID NO: 202146 - DNA, 578 bp, Homo sapiens
  Payload ID: 19876
  Gene Name: zinc finger protein 324B
  ENST ID: ENST00000599193
  CDS Start-End: 136-578
acttggctgctcgcgtcaggccacaccggtggtctgggctgtggcgcgcgggtcggggcccgaggcgggcggccaggaaggtacggaccacgagcagccggccgcgcccccaagcctcggtatcttcgagacctgatgaccttcgaggatgtggccgtgtacttctcccaggaggagtgggggctcctggacacagcgcagagggccctgtaccgccacgtgatgctggaaaacttcacacttgtgacctcacttggactctctacctcccgacctcgtgtggtcattcaacttgagcgtggcgaggagccctgggttcccagtggaaaggacatgaccctggccaggaacacctacgggaggctcaactctggttcctggagtttgacagaggatagagatgtttctggagaatggccacgagctttcccagataccccacctgggatgactactagcgtcttcccagttgccgatgcctgccacagtgtaaaaagcctgcagcgacaaccgggtgcctccccatctcaggagagaaaacccacgggggtgtcggtgatctactgggagaggctcct

SEQ ID NO: 202147 - DNA, 2729 bp, Homo sapiens
  Payload ID: 19877
  Gene Name: zinc finger protein 326
  Uniprot ID: Q5BKZ1
  ENST ID: ENST00000340281
  CDS Start-End: 144-1892
cgctgtggcctgcggctcccgggctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggagggatggatcgtgactatggccatggatcctatgggggtcagagatccatggattcctacctaaaccagtcatatggcatggacaatcacagtggtggtggtgggggtagcaggtttggaccttatgagtcttacgactccaggtcttctctgggtgggcgagatctgtacagatctggctatggttttaatgaacccgaacaaagccgcttcggaggtagttatggtggtcgatttgagagctcctaccggaatagccttgactctttcggaggtagaaaccagggcgggtctagctgggaagcaccttactcccgttcaaaattgaggcctgggtttatggaggacagaggaagagagaattactcttcctacagcagtttttcttcaccccatatgaagcctgcacctgtaggctctcgggggagaggaacgcctgcttatcctgaaagtacgtttggaagcagaaactatgatgcttttggaggaccatcaacaggcagaggccgaggccgaggacatatgggtgattttggaagcattcatagacccggaattgttgttgactatcaaaacaaatccaccaatgtgacagttgctgctgcaagaggaataaagagaaaaatgatgcagccatttaataagcccagtggaacctttatcaagaaacccaaactagcaaaacctatggagaagataagcctcagcaaatcacccacaaaaactgatcctaaaaatgaagaggaagaaaagcggcgaattgaggctcggcgagagaaacaaaggcgcagaagagaaaaaaacagtgagaaatacggagatggatacagaatggcatttacatgttcattttgtaaatttcgaacatttgaagaaaaagatattgaactgcatctggaaagttcttcacatcaggaaacattagatcatatacagaaacaaactaaatttgataaagtagttatggagtttttgcatgagtgtatggtgaataaattcaagaaaacatctattcgtaagcaacagacaaataatcaaacagaagtagttaaaataattgaaaaagatgttatggaaggtgttactgtagatgatcacatgatgaaggtagagacagttcattgcagcgcttgcagtgtttatatccctgctttacatagttcagttcagcagcacttaaaatctcctgatcatatcaaagggaagcaggcttataaggaacaaataaaaagagagagtgtcttgactgctacaagcattttaaataatccaatagtgaaggcgcgatatgaacgttttgttaagggtgagaatccttttgaaattcaagaccattctcaggatcagcaaatagaaggagatgaggaggatgaagagaagattgatgaacctattgaagaagaggaggatgaagatgaggaagaagaagcagaggaagtgggggaagtagaggaagtggaagaagtagaggaagtgagagaaggaggaatagagggcgagggaaatatacagggagtaggggaaggaggggaagtaggggtagtgggagaagtagagggagtgggggaagtagaggaagtagaggaattagaggaagagacagcaaaggaagaacctgctgacttccctgttgagcaacctgaagaaaattaaatataaggtattagatttaaaaggagctttacatttcggttctaatgtaaaaaagggtaagaaatttaatagcttaaaatatgaattaacacccatgttgcatgcattccacatattaaaatttgttttatataatttctaaatgtttaacatttgtttaataaaatgaaggcaaaactattttagtttagtttttatagctaccagacttagatccgataaattgtttgtataatttttaagcttaatttttattactttattggtgttaaggataacaaatgtgtattgttagtatatctattctaatcattttatcttaaatgctgctcttgggagtgaatattcaagtgtgcatcaattttttgaatacttaccctggaagatataaactgggcaagtattttgtgctctgtgtatttttttactgcattagacattgaatagtaatttgcgttaagatacgcttaaaggctctttgtgaccatgtttccctttgtagcaataaaatgttttttacgaaaactttctccctggattagcagtttaaatgaaacagagttcatcaatgaaatgagtatttaaaataaaaatttgccttaatgtatcagttcagctcacaagtattttaagatgattgagaagacttgaattaaagaaaaaaaaattctcaatcatatttttaaaatataagactaaaattgtttttaaaacacatttcaaatagaagtgagtttgaactgaccttatttatactctttttaagtttgttccttttccctgtgcctgtgtcaaatcttcaagtcttgctgaaaatacatttgatacaaagttttc

SEQ ID NO: 202148 - DNA, 1538 bp, Homo sapiens
  Payload ID: 19877
  Gene Name: zinc finger protein 326
  Uniprot ID: Q5BKZ1
  ENST ID: ENST00000361911
  CDS Start-End: 125-337
cgggctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggagggatggatcgtgactatggccatggatcctatgggggtcagagatccatggattcctacctaaaccagtcatatggcatggacaatcacagtggtggtggtgggggtagcaggtaaattgcttaatcatttggccaaataattagacaactataagattttggatatattattttaagtactctttaggcatgttatgatacttgaacttcactgtttgctattgaatcatcaccttaaatatttaaaggtgttaattaatgggtataaaatttaaatcagtattactggcagacgttattttaggaaaacaccagataactatatcatgtcaatataatagagtaagatacactttttagcagtgaacttttaaaaaattcttttacttttaacttcttgtcaatcaaagtatcctgaaaaatgatataaaaatgttattgaaaatattatttatgaagctttttcttaataattaaaaaaaatcttttctaatgtggggtgctatgtaaattagcaaagcagtctaactagaatggattttactgaaccagtctaacatttactttccaagaaacattcaggacatattcctttaattctaattttaaaggaagagcatattgcaataataaaaatatttttaaaattatgttcaggttatttattgacaggtactacttacaccaaagcacttgtgctctaggctagaagcattgtattaaagccatgaatactatacctttgactagtcgagattgtatttatattttcctgttactactgtataaagcttaaacctacttaaacaactacaagctttaaggttgaccatatttcaggagaaggggtgtctactttttgaggcacaaaggttcctgctgaatataagtaaaactagttagtagacatgtgaaacagtcatccttctgcataaattgaaggatccggattccttaatgatggactgaatgatgcttactttccttctttctgcttccagtgtaccactatggtttatagtaaagaaaaattaagaaagtgaacagttgcaactattttgcttatgtgatagatgttttgaaaaatgtagttggaaataggaataatttttatatggttactaggattcagaagtaaatctatttagtgatctgtaaataattgaagtaatgtaacacttaatgttttaatatgtcagttattgcccttttatattgtgaatgtaatgtgcataagctatatccgtagatgttattgttttatctcatgtgtaattgtgggcctttataaaattgtgttgtaagatatcaagcaa

SEQ ID NO: 202149 - DNA, 9433 bp, Homo sapiens
  Payload ID: 19877
  Gene Name: zinc finger protein 326
  ENST ID: ENST00000370447
  CDS Start-End: 122-1603
gctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggagggatggatcgtgactatggccatggatcctatgggggtcagagatccatggattcctacctaaaccagtcatatggcatggacaatcacagtggtggtggtgggggtagcagtttttcttcaccccatatgaagcctgcacctgtaggctctcgggggagaggaacgcctgcttatcctgaaagtacgtttggaagcagaaactatgatgcttttggaggaccatcaacaggcagaggccgaggccgaggacatatgggtgattttggaagcattcatagacccggaattgttgttgactatcaaaacaaatccaccaatgtgacagttgctgctgcaagaggaataaagagaaaaatgatgcagccatttaataagcccagtggaacctttatcaagaaacccaaactagcaaaacctatggagaagataagcctcagcaaatcacccacaaaaactgatcctaaaaatgaagaggaagaaaagcggcgaattgaggctcggcgagagaaacaaaggcgcagaagagaaaaaaacagtgagaaatacggagatggatacagaatggcatttacatgttcattttgtaaatttcgaacatttgaagaaaaagatattgaactgcatctggaaagttcttcacatcaggaaacattagatcatatacagaaacaaactaaatttgataaagtagttatggagtttttgcatgagtgtatggtgaataaattcaagaaaacatctattcgtaagcaacagacaaataatcaaacagaagtagttaaaataattgaaaaagatgttatggaaggtgttactgtagatgatcacatgatgaaggtagagacagttcattgcagcgcttgcagtgtttatatccctgctttacatagttcagttcagcagcacttaaaatctcctgatcatatcaaagggaagcaggcttataaggaacaaataaaaagagagagtgtcttgactgctacaagcattttaaataatccaatagtgaaggcgcgatatgaacgttttgttaagggtgagaatccttttgaaattcaagaccattctcaggatcagcaaatagaaggagatgaggaggatgaagagaagattgatgaacctattgaagaagaggaggatgaagatgaggaagaagaagcagaggaagtgggggaagtagaggaagtggaagaagtagaggaagtgagagaaggaggaatagagggcgagggaaatatacagggagtaggggaaggaggggaagtaggggtagtgggagaagtagagggagtgggggaagtagaggaagtagaggaattagaggaagagacagcaaaggaagaacctgctgacttccctgttgagcaacctgaagaaaattaaatataaggtattagatttaaaaggagctttacatttcggttctaatgtaaaaaagggtaagaaatttaatagcttaaaatatgaattaacacccatgttgcatgcattccacatattaaaatttgttttatataatttctaaatgtttaacatttgtttaataaaatgaaggcaaaactattttagtttagtttttatagctaccagacttagatccgataaattgtttgtataatttttaagcttaatttttattactttattggtgttaaggataacaaatgtgtattgttagtatatctattctaatcattttatcttaaatgctgctcttgggagtgaatattcaagtgtgcatcaattttttgaatacttaccctggaagatataaactgggcaagtattttgtgctctgtgtatttttttactgcattagacattgaatagtaatttgcgttaagatacgcttaaaggctctttgtgaccatgtttccctttgtagcaataaaatgttttttacgaaaactttctccctggattagcagtttaaatgaaacagagttcatcaatgaaatgagtatttaaaataaaaatttgccttaatgtatcagttcagctcacaagtattttaagatgattgagaagacttgaattaaagaaaaaaaaattctcaatcatatttttaaaatataagactaaaattgtttttaaaacacatttcaaatagaagtgagtttgaactgaccttatttatactctttttaagtttgttccttttccctgtgcctgtgtcaaatcttcaagtcttgctgaaaatacatttgatacaaagttttctgtagttgtgttagttcttttgtcatgtctgtttttggctgaagaaccaagaagcagacttttcttttaaaagaattatttctctttcaaatatttctatcctttttaaaaaattcctttttatggcttatatacctacatatttaaaaagagaacatgagcttgatagaggatctattcttaaataatttattttcaaacaaccgtctatgtcactaaaaagtagtgctcttatttttttcaatctttactgtggcctcttttgagagtagggtccgtagttttttttttttttcttttttgggacagggtttcactctgtcacccaggctggagtgcagtgtagcctcaacctcctgggctcaagcgatcctccaacttagcctcccaagtagctgggactgttaagtgtgagccaccatgcccagctaatttttgtagtttttgtagagacagggttttaccatgttgtccaggctggttttgaactcctgggctcaagtgacctgtctgtcttggcctcccacagtgctgggattgcaggtgtgagccaccatgcctggcatagggggctgtatttcagtgaaattagaaaagttttgaggcatcgaatggataaatggatggatatatcaaattgtaaggtattaagtgggtgaatgtatggacatttgtagaatcccacagataatttatctttttgtgtaaaataaggcttttaaaactagactttctgaaccaatacagttttttttttttgaggtgaactaggtttgcctagctttaagctagcaatatctgatagatacttgcatctaattttagggatttggtgccaaataagagaagggtagttgaagactagataaatttggatactatctaggagtctgtatttacttagcaggcttttgaaagccgttttgcttaggagttcaaattttaaggataataggacttgttaccctcttatttctcctttatttttaaaaatatttgtggaagggctaaggtaaaagaataataaattcctctaggttattagtatttggttcttctgatactaagctgagtgattttttttaaaacaatgtctctggtagtctgattgagatatgaaacttttgggaagaaaaccattatgtaacaagaatcctatgtaacaactgggtaaatgttttagaatgagagataggaaagaacatctaaatagtacttttttgtgggacgcatgagcctttatacagcctagctaatttgcaaggtaatgataaataaaagtgtattttgttactgtgcttaattcagaaattcaaattcatgtatttcctattggataatttgtaggcgggcagtttactttatagtcaggttagtttttgtgatccttagtgtttatatttgcattgcttttgtaataaggatgtatataagatcttaaacgcctttcaacttctgttttcaagtatcacttgttttctctattacaaagtgagatacatagttctaaataaccaaagaaatttatttataacctacacagttgtttcagctccatgcctagggactatcctgtattattcgctttttatcactttctacctacagtctaccaaaaagtctgtctgttctacttccaaaatttatctgccgactcttctacctccactgcaaccaacccagttcaagtcatgataatttcttgttaactaatcttgattccacccttaccatgatagattcagttttctacacaagtataagcttttaaaaatgtaattcagatgatgttaatctcatgctttttttttttttgtacctatacagttagaactccttatcatgttgatcagactggcctagctttacaactttatatcatataccattcttaccagccataatggccttttgttacttttttgatgagttctttcctacaaagacctttgcattttcttattctatagcctatacccatcagctttccttggctgattcttcatccttcaggtcaccttaaatgttagaaaaggggagtagttctaaaatgtttgtagaaacgaggatttgggggtaccaacctagattttactagagcatattctttggaggtgttctttttttctactttttttttttttttctttaggttctgtctttgtcatgcaggctggaattcagtggcacgatcatggcttactgcagctttgacctcctgggctcaagcggtcgtcccgccttagcctcccaagtagctgggaccacagacgtgcaccatcacactcagctaatattttttttgtagagatggggtcttgctttgttgcccaggctagtcttgaactcctggacacaagcagtcctcccacctcagcttcccaaagtgctagaattacaggcatgagccaccacgcctatcctggaggtgatatatttttaacaaatatctcacatgattttgaaggtagtggtcagtgattgcactttgaggacattcatagggccctcatacaaatttctggtgcctgtaactcttcccctatcaaggcaggagtttccgcccttttgaatataaacataggtttgggggattcttcataatactttctgaaagcactggaatctataacagacctgtgggagtcagaaaatggggacttttcccccctcatttaatacttacaactatattggtaagttagtaggagtagtaattttcccatataataagcccactcttgtacatgtagaaacagagaaaagaactacaaaggtaaatgttagtgcatgttgaaatgtatttaagaactctgtttttgttggcaagattgttcttattgtagaagtggatattatcagattattttagatgttattcaacatttgatttatttaccaaattgtccttactttgaatataagcaaacttttttattgtggtaaagtatacatagcataaaattaccattctaatcattttttaatgtaccatttagtggcattaattacaagcaaccttttttttttttttttgagacatagcctcactctgtcacccaggctggagttcagtggcactatctcagctcactgcaatctctgcttcctgggttcaagcgattcttgtgcctcagccctcccgagtaactgggattacaggcacacaccaccatgcccagctaatttttttgtatttttaatagagatggggtttcattatattggttaggttggtcttgaactcctgacctcaagtgatctgcctgccttggcctcccaaagtgctgggattataggcatgagccaccgcgtctggcatacaaacttttgattacagtttgacacctgttgatggacagaaaatggagtaaccgtccaggcaggaatgttctagtctgtgtgacagttacagttcattttataaataaacaattgactttttttggtagttatggtccctaccctcagtgctgtatctctatttggtattcaaacaaatccagggaatctgcaaggctgaagggcagattcttggcaatggtaaattcagtaggtcctgccaccatttgaggcctcctcggagacagccatactagtctaatctcttcttgactttcccttcttctttcccagtcctctaattcccagaggtctgttgtgaattctaatgctttcagaaaatattacggagaatcccacaatgataaaatttcccagtttttgttttaaaacaaagttgaaaaatattatattaggggtcagggtgaggtgctgttgatggtgacagatggcccccttggcgacagggaagtatgaaatagcatggagtgtggaagggtactatgggtagcttatttattagatcagtataaagtatagatttaagagagttagattaaaatggcatgcttgattcaagtcattaaattctaaagttctattaaaattgtagaggagatacaataatacaaatttcagcaataaggatagatttataatcacactaggaagacaagaagggtgctgtgaaatatttctagaagatacaaaacaaggaattagatcttggtgaaaccaagagagccaaggaactgacagccacatgccgatgataattaaagaattacctccagttgtagagacagctctgagatggggtgtctgtagtgtgctaagccagatttttgaaggactagatagttattctggtctctgactcagagctgctggtccacagaattcctctaagctaaagctgtaacacaatttgatgtttgccaaataaggtgagactcacagagtatatgtgcagagcatataatgcagagcatacaaataggggccatcgaagtgtggcaatgccctaggtatattgtgattaccacaaggagctttattcctcatacttagaaaacaagcacacaaagaaaaatctgccagctgtctatttcccaattttccttctgactgttcctttctccttcctcacacaattaaaatgctaggtttcctgtaatcgcaatcttcagggaatttttcactcaagcccagaaaataaactccagataatgatactgagaaatttattggttggaaaactgctatctacaggccttccactacctatttcttagtagattttacatttttaaagggttgtagaacaccaaaacaatatatgacagatactgtgtttgggccttaaagcctaccctttatataaaaagtttgttgactcctaggctctcatttgcaagtagacaaatgagaaacagcaaatatttaaggaaaagagcaacatgaaaaatacacagcaaacttaacaagcagaaagaattcctggggaaacaattcagggggaaaaaatgaccaagtataattagtattatatggaataataattactactacttataatagtttcatatgtaatcctcatcatattatatgtcataatcttcaaatattttagaggttattgtactaattttaaaaatgcaagttgctataaagaagtatcttggaaataaacagttgtgaaaataaactctgttttaggctgattagttgaataaacatggctgagaatcaaattactgagctagaattttgagctgaagatacttccagagcttacaagaaaagataaaaaagatggaagttacagtaaaagacatagatgtatctcttaaagacatagaaaacccagaacaccatctgtttaaaaattaaacttcatgagattaagagccatatgtatagagaattcaccattgaataccctgcatatatcacagtgccaggtaaatactatgcaataaatatttttgaatgtatgtatgtatgttacagtataaatatatagaggagttccagaaagtgaaaaaagaagtgaagaataggaaaaaaaaaaaaatcttctgatgaaagattcatattagaagtctccagtgctgagcaaaaacaatgaaaaagtcatgcaggatgaatactgacaaaatatgtgtaatcccaagcttagaaaaatctcaaaatgtctaaagagaaacagtgtacctataaggggaaaagaatcacattggtctcagacttgtcatctgttcgttggagtgctacaacatactgctatttttgaagttctgagggagaactgttttgaatttagacttctatcttgagtgaaactgtcaagagtaagggcacagcaaggacattctaccaattttagaacatgcaaggatttcagaaattaactcataaaacacaacctgcacggcatggtatcaaattatgtaaagaaaaacttggtaaacaagaaattgtcaaatttataatcatagctacgtatttgaacacagcgcttagaaattgtcagataaagagttcaaaatagaggaaacattttgaattatatagtgcacaaattttaatagctatagaatatttgttttcaaatgccatgaaaaaatgaccatgaagcaaaaaccacaatatttttttgtttgttgataggtaggaattcagggtccatcctgtcatcacaatgcaatgaaacaaaaaattagcaagtggatagcaataaatcaatttttaaaaatcagacaaaagaaaacactgtccttgtaatgcttgcatttaaaaggaaataaaaacttatgaaagagaatctttattttatttaagcagttctagattatacaaaatgttgaaacatctcaatttggtctctgaggctagcataatccttattccagaaaattgttcatcaaagatagctatagaccagtctcacttacgaacaaatgtaatttgttgaaactggtcatgttgaaaaaacatgaccaattaaatatcccaaaataatgtgtcatggtagagtagggtttatctgaaaactgcaacatgacgattatgtaactcaatcctttaggaaatttattactttaacttaaaaaaaaataccataagcttgatagatgctcgaaaaacatttcctaagattgaacacattccagatttaaatttttcaggctgagaatagaataaagcctttgtaacttggctaaggactaggaaggtcttccagaaagcttcatcaaacatctgcattcaagtcaggattaagacaataatgactgttgcctatgcaacaatcatttaaccctaagaaatagaagtattaggaagagaaaacatagtccttattttgagcagtgtgattgtagagacaaacatccaagagaaacagttgaaaaactattagaaatgacaaaaggtagttttgtttaatagttcaccatgaaaatctgtactatatagaaaatctgtatatagaatatagcattggccaattggaaatgtaatttgaaaatcccatttgcagcaaaacttggaactgtatactgtctaagaataaacaatgggaaaaatgcaaaatccttatgaggaaaatgatacattttaatggaggaaataaaatgcctgaataaa

SEQ ID NO: 202150 - DNA, 1956 bp, Homo sapiens
  Payload ID: 19877
  Gene Name: zinc finger protein 326
  ENST ID: ENST00000394583
  CDS Start-End: 147-308
cctcgctgtggcctgcggctcccgggctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggaggtctgacattcaaggatatttatctaaaaattcttcttttgagtgccagtaaagcatatgggtgattttggaagcattcatagacccggaattgttgttgactatcaaaacaaatccaccaatgtgacagttgctgctgcaagaggaataaagagaaaaatgatgcagccatttaataagcccagtggaacctttatcaagaaacccaaactagcaaaacctatggagaagataagcctcagcaaatcacccacaaaaactgatcctaaaaatgaagaggaagaaaagcggcgaattgaggctcggcgagagaaacaaaggcgcagaagagaaaaaaacagtgagaaatacggagatggatacagaatggcatttacatgttcattttgtaaatttcgaacatttgaagaaaaagatattgaactgcatctggaaagttcttcacatcaggaaacattagatcatatacagaaacaaactaaatttgataaagtagttatggagtttttgcatgagtgtatggtgaataaattcaagaaaacatctattcgtaagcaacagacaaataatcaaacagaagtagttaaaataattgaaaaagatgttatggaaggtgttactgtagatgatcacatgatgaaggtagagacagttcattgcagcgcttgcagtgtttatatccctgctttacatagttcagttcagcagcacttaaaatctcctgatcatatcaaagggaagcaggcttataaggaacaaataaaaagagagagtgtcttgactgctacaagcattttaaataatccaatagtgaaggcgcgatatgaacgttttgttaagggtgagaatccttttgaaattcaagaccattctcaggatcagcaaatagaaggagatgaggaggatgaagagaagattgatgaacctattgaagaagaggaggatgaagatgaggaagaagaagcagaggaagtgggggaagtagaggaagtggaagaagtagaggaagtgagagaaggaggaatagagggcgagggaaatatacagggagtaggggaaggaggggaagtaggggtagtgggagaagtagagggagtgggggaagtagaggaagtagaggaattagaggaagagacagcaaaggaagaacctgctgacttccctgttgagcaacctgaagaaaattaaatataaggtattagatttaaaaggagctttacatttcggttctaatgtaaaaaagggtaagaaatttaatagcttaaaatatgaattaacacccatgttgcatgcattccacatattaaaatttgttttatataatttctaaatgtttaacatttgtttaataaaatgaaggcaaaactattttagtttagtttttatagctaccagacttagatccgataaattgtttgtataatttttaagcttaatttttattactttattggtgttaaggataacaaatgtgtattgttagtatatctattctaatcattttatcttaaatgctgctcttgggagtgaatattcaagtgtgcatcaattttttgaatacttaccctggaagatataaactgggcaagtattttgtgctctgtgtatttttttactgcattagacattgaatagtaatttgcgttaagatacgcttaaaggctctttgtgaccatgtttccctttgtagcaataaaatgttttttacgaaaa

SEQ ID NO: 202151 - DNA, 3290 bp, Homo sapiens
  Payload ID: 19878
  Gene Name: zinc finger protein 329
  Uniprot ID: Q86UD4
  ENST ID: ENST00000358067
  CDS Start-End: 117-1742
cagagatggctggagccgtgtggatgggcataaatggctaatgtccagcaaccatcgatgtcaagtatccacacacctggcctgaatggatccctctgcctttcagagtttgggatatgagattgaaaatgacgactcggaattttcctgagagagaagtaccctgtgatgtagaagtggaaagattcacaagggaagttccctgcttgtccagtttaggtgatggttgggactgtgagaaccaggagggacacttgaggcaatcagctttaactctggagaaaccagggactcaggaagcaatttgtgaatatcctggttttggggagcatttgattgcaagctcagaccttccaccgtctcagagagttctggcaacaaatggtttccatgcacctgactcaaatgttagtggtctggattgtgaccccgccttacccagctatcctaaaagttatgcagataagagaactggtgacagtgatgcctgtggaaaaggcttcaaccattccatggaagttattcatggaagaaatccagtgagagagaagccctacaaataccctgaaagtgttaagtcttttaatcattttacctctcttggtcatcagaaaataatgaaaagaggcaagaaatcgtatgaaggtaagaattttgagaacatctttactctgagctcatcgcttaatgaaaaccagagaaatctccctggagagaaacaatatagatgtactgaatgtggcaaatgcttcaaacggaactcttctcttgttttgcatcaccgaactcacaccggagagaagccttatacttgtaatgagtgtggaaagtccttctccaagaactacaacctgattgtgcatcaaagaatccacacaggagagaagccctatgaatgcagtaaatgtgggaaagctttcagtgatggctcagctctgacacagcaccagagaattcacacaggcgagaaaccttatgaatgcctagagtgtggaaaaaccttcaaccgaaattcatccttaattttgcaccaaagaactcatacaggggaaaaaccatatagatgtaacgaatgtgggaaacccttcactgacatctcccaccttacagtgcatctcagaatccacaccggtgagaagccctatgagtgtagcaaatgtggaaaggctttccgggacggctcgtacctcacccagcatgagaggactcacactggagaaaagccctttgagtgtgcagagtgcgggaaatccttcaacagaaactctcacctcattgtgcatcaaaagatccattctggggagaaaccctatgaatgtaaagaatgtggcaagactttcatcgagagtgcgtacctcatcaggcatcagaggattcatactggcgagaagccctatggctgcaaccagtgtcagaaacttttcaggaatatcgctggcctcattaggcaccagaggactcatactggtgagaagccctatgagtgtaatcagtgtggcaaagccttcagggacagctcctgtctgaccaagcaccagagaattcacactaaggagaccccatatcagtgtccagaatgtgggaagtccttcaagcagaactctcacctggcagtacatcagagactccatagcagggagggtcccagccggtgtcctcagtgtggaaaaatgttccaaaagagctcatcccttgttcgacatcaaagagcacacctgggagagcaacccatggaaacataatggttgggggccacatgagtcttccagttcactctcactcctgtgtttaggaggcgtgtcttagatctgactcctctctggtcagtagaaaagaatcctttaagctatccagtgaattgatgaatgtgagacattgctgagccacactgttaagtctgctcattggggaactccagagacaacttaggatgagggcagaaaagtctttggggatgattcagtctgtaccagacatgacaacacacacactggaatgaaatgtgcaaacatgggggtgacaccacagagagaacctgtgaatgcattcagaacatgattggaatgaagagccctgtagtagggagtttccaccttgtacgtaagcaaacactgaatcaacttttttttttttttcggacagagtctcactgtgcagtggcatgatctccactcacagcaacctctgcctcccaggttcaagcagttctcctgcctcagcctccaaagtagctaggattacaggtgcctgccaccatgcctggctaattttttctatttttagtagagacagggtttcactgtgttggccaggctggtcttgaactcctgacctcatgatccgcccacctcagcctcccaaagtgttgggattacaggcatgagacactgcctggcctgaatcaaccttttttaagtgtaatcagaaagagaggctttggcaggggctcttactgtgttttctgtaacaacaaaggtgtacaatgagagagtccacacagtgctgtactgcacacaccacagaatgtgtgagattttcctgtttgaatgtatgtctgcattatactcctgcaataatgctgaggactcgttgcaggagggcaaactaggtgaataaattacctgtgaatgaacaatgaagtcgttcctcttaagactgaaacaagcaggccagatgtggtggctcacgcctgtaatcctagcactttgggaggccgaggcggccagatcacaaggttaggagttcaagaccagcctggccagcatggtgaaaccccatctctaccaaaaatacaggaaattatctgggcatagtagtgtgtgcctgtaatcccagctacttgggaagctgaggcaggagaattgcttgaacctgggaggtggaggttgcagtgagctaagatcgcaccactgcactccagcctgggtgacagagcgagactccatttcaaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttggggactgg

SEQ ID NO: 202152 - DNA, 3091 bp, Homo sapiens
  Payload ID: 19878
  Gene Name: zinc finger protein 329
  Uniprot ID: Q86UD4
  ENST ID: ENST00000500161
  CDS Start-End: 584-2209
atgcgcaatggagggtccggcgtccgccttggcgggtgggagtgatgacctgcactccccaaaccactgcgggatagaacggggccgagtgctctcaggggtggccgctaccggggcggcccgagacacggctgcgggttccagccaacaggcccggagtcgcggcctcggctccgccgtgggtgcacgggctagggctgcggggactcctgtgggctccgcgtctgcggctgggaggaatggggatcgtccccagatcccgccttccgggcagggcctccgctgcctgcgatcctgcccacagtccaaggatcctcctcgcctctcgcggactgcggtgtcagccgcccgagccgttccccggacacctggccagggtcttgctgtctcacccaggctggagtgcagtggcacgatcacagctcactgcagccttgagctcctgggctaccaagtagctgggacttcagagatggctggagccgtgtggatgggcataaatggctaatgtccagcaaccatcgatgtcaagtatccacacacctggcctgaatggatccctctgcctttcagagtttgggatatgagattgaaaatgacgactcggaattttcctgagagagaagtaccctgtgatgtagaagtggaaagattcacaagggaagttccctgcttgtccagtttaggtgatggttgggactgtgagaaccaggagggacacttgaggcaatcagctttaactctggagaaaccagggactcaggaagcaatttgtgaatatcctggttttggggagcatttgattgcaagctcagaccttccaccgtctcagagagttctggcaacaaatggtttccatgcacctgactcaaatgttagtggtctggattgtgaccccgccttacccagctatcctaaaagttatgcagataagagaactggtgacagtgatgcctgtggaaaaggcttcaaccattccatggaagttattcatggaagaaatccagtgagagagaagccctacaaataccctgaaagtgttaagtcttttaatcattttacctctcttggtcatcagaaaataatgaaaagaggcaagaaatcgtatgaaggtaagaattttgagaacatctttactctgagctcatcgcttaatgaaaaccagagaaatctccctggagagaaacaatatagatgtactgaatgtggcaaatgcttcaaacggaactcttctcttgttttgcatcaccgaactcacaccggagagaagccttatacttgtaatgagtgtggaaagtccttctccaagaactacaacctgattgtgcatcaaagaatccacacaggagagaagccctatgaatgcagtaaatgtgggaaagctttcagtgatggctcagctctgacacagcaccagagaattcacacaggcgagaaaccttatgaatgcctagagtgtggaaaaaccttcaaccgaaattcatccttaattttgcaccaaagaactcatacaggggaaaaaccatatagatgtaacgaatgtgggaaacccttcactgacatctcccaccttacagtgcatctcagaatccacaccggtgagaagccctatgagtgtagcaaatgtggaaaggctttccgggacggctcgtacctcacccagcatgagaggactcacactggagaaaagccctttgagtgtgcagagtgcgggaaatccttcaacagaaactctcacctcattgtgcatcaaaagatccattctggggagaaaccctatgaatgtaaagaatgtggcaagactttcatcgagagtgcgtacctcatcaggcatcagaggattcatactggcgagaagccctatggctgcaaccagtgtcagaaacttttcaggaatatcgctggcctcattaggcaccagaggactcatactggtgagaagccctatgagtgtaatcagtgtggcaaagccttcagggacagctcctgtctgaccaagcaccagagaattcacactaaggagaccccatatcagtgtccagaatgtgggaagtccttcaagcagaactctcacctggcagtacatcagagactccatagcagggagggtcccagccggtgtcctcagtgtggaaaaatgttccaaaagagctcatcccttgttcgacatcaaagagcacacctgggagagcaacccatggaaacataatggttgggggccacatgagtcttccagttcactctcactcctgtgtttaggaggcgtgtcttagatctgactcctctctggtcagtagaaaagaatcctttaagctatccagtgaattgatgaatgtgagacattgctgagccacactgttaagtctgctcattggggaactccagagacaacttaggatgagggcagaaaagtctttggggatgattcagtctgtaccagacatgacaacacacacactggaatgaaatgtgcaaacatgggggtgacaccacagagagaacctgtgaatgcattcagaacatgattggaatgaagagccctgtagtagggagtttccaccttgtacgtaagcaaacactgaatcaacttttttttttttttcggacagagtctcactgtgcagtggcatgatctccactcacagcaacctctgcctcccaggagaattgcttgaacctgggaggtggaggttgcagtgagctaagatcgcaccactgcactccagcctgggtgacagagcgagactccatttcaaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttgggg

SEQ ID NO: 202153 - DNA, 3410 bp, Homo sapiens
  Payload ID: 19878
  Gene Name: zinc finger protein 329
  Uniprot ID: Q86UD4
  ENST ID: ENST00000598312
  CDS Start-End: 235-1860
gaacatggctgccgccggccgccaaccggtcttgctgtctcacccaggctggagtgcagtggcacgatcacagctcactgcagccttgagctcctgggctaccaagtagctgggacttcagagatggctggagccgtgtggatgggcataaatggctaatgtccagcaaccatcgatgtcaagtatccacacacctggcctgaatggatccctctgcctttcagagtttgggatatgagattgaaaatgacgactcggaattttcctgagagagaagtaccctgtgatgtagaagtggaaagattcacaagggaagttccctgcttgtccagtttaggtgatggttgggactgtgagaaccaggagggacacttgaggcaatcagctttaactctggagaaaccagggactcaggaagcaatttgtgaatatcctggttttggggagcatttgattgcaagctcagaccttccaccgtctcagagagttctggcaacaaatggtttccatgcacctgactcaaatgttagtggtctggattgtgaccccgccttacccagctatcctaaaagttatgcagataagagaactggtgacagtgatgcctgtggaaaaggcttcaaccattccatggaagttattcatggaagaaatccagtgagagagaagccctacaaataccctgaaagtgttaagtcttttaatcattttacctctcttggtcatcagaaaataatgaaaagaggcaagaaatcgtatgaaggtaagaattttgagaacatctttactctgagctcatcgcttaatgaaaaccagagaaatctccctggagagaaacaatatagatgtactgaatgtggcaaatgcttcaaacggaactcttctcttgttttgcatcaccgaactcacaccggagagaagccttatacttgtaatgagtgtggaaagtccttctccaagaactacaacctgattgtgcatcaaagaatccacacaggagagaagccctatgaatgcagtaaatgtgggaaagctttcagtgatggctcagctctgacacagcaccagagaattcacacaggcgagaaaccttatgaatgcctagagtgtggaaaaaccttcaaccgaaattcatccttaattttgcaccaaagaactcatacaggggaaaaaccatatagatgtaacgaatgtgggaaacccttcactgacatctcccaccttacagtgcatctcagaatccacaccggtgagaagccctatgagtgtagcaaatgtggaaaggctttccgggacggctcgtacctcacccagcatgagaggactcacactggagaaaagccctttgagtgtgcagagtgcgggaaatccttcaacagaaactctcacctcattgtgcatcaaaagatccattctggggagaaaccctatgaatgtaaagaatgtggcaagactttcatcgagagtgcgtacctcatcaggcatcagaggattcatactggcgagaagccctatggctgcaaccagtgtcagaaacttttcaggaatatcgctggcctcattaggcaccagaggactcatactggtgagaagccctatgagtgtaatcagtgtggcaaagccttcagggacagctcctgtctgaccaagcaccagagaattcacactaaggagaccccatatcagtgtccagaatgtgggaagtccttcaagcagaactctcacctggcagtacatcagagactccatagcagggagggtcccagccggtgtcctcagtgtggaaaaatgttccaaaagagctcatcccttgttcgacatcaaagagcacacctgggagagcaacccatggaaacataatggttgggggccacatgagtcttccagttcactctcactcctgtgtttaggaggcgtgtcttagatctgactcctctctggtcagtagaaaagaatcctttaagctatccagtgaattgatgaatgtgagacattgctgagccacactgttaagtctgctcattggggaactccagagacaacttaggatgagggcagaaaagtctttggggatgattcagtctgtaccagacatgacaacacacacactggaatgaaatgtgcaaacatgggggtgacaccacagagagaacctgtgaatgcattcagaacatgattggaatgaagagccctgtagtagggagtttccaccttgtacgtaagcaaacactgaatcaacttttttttttttttcggacagagtctcactgtgcagtggcatgatctccactcacagcaacctctgcctcccaggttcaagcagttctcctgcctcagcctccaaagtagctaggattacaggtgcctgccaccatgcctggctaattttttctatttttagtagagacagggtttcactgtgttggccaggctggtcttgaactcctgacctcatgatccgcccacctcagcctcccaaagtgttgggattacaggcatgagacactgcctggcctgaatcaaccttttttaagtgtaatcagaaagagaggctttggcaggggctcttactgtgttttctgtaacaacaaaggtgtacaatgagagagtccacacagtgctgtactgcacacaccacagaatgtgtgagattttcctgtttgaatgtatgtctgcattatactcctgcaataatgctgaggactcgttgcaggagggcaaactaggtgaataaattacctgtgaatgaacaatgaagtcgttcctcttaagactgaaacaagcaggccagatgtggtggctcacgcctgtaatcctagcactttgggaggccgaggcggccagatcacaaggttaggagttcaagaccagcctggccagcatggtgaaaccccatctctaccaaaaatacaggaaattatctgggcatagtagtgtgtgcctgtaatcccagctacttgggaagctgaggcaggagaattgcttgaacctgggaggtggaggttgcagtgagctaagatcgcaccactgcactccagcctgggtgacagagcgagactccatttcaaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttggggactggaa

SEQ ID NO: 202154 - DNA, 3930 bp, Homo sapiens
  Payload ID: 19878
  Gene Name: zinc finger protein 329
  Uniprot ID: Q86UD4
  ENST ID: ENST00000597186
  CDS Start-End: 679-2304
aatcgcccggaacatggctgccgccggccgccaaccggtcttgctgtctcacccaggctggagtgcagtggcacgatcacagctcactgcagccttgagctcctgggctaccaagtagctgggacttcagagatggctggagccgtgtggatgggcataaatggctaatgtccagcaaccatcgatgtcaagtatccacacacctggcctgaatggatccctctgcctttcagagacggagtctcgctctgtcccccaggctggagtgcaatggtataatcttgtctcactgcaacctctgcctcctaggctcaagcgattctcctacctcagcctcccgagtagctgggattacatgcatgcgccaccgcgtccagctaatttttgtatttttagtagagacatagttgcccaggctggtcttgaactcctgaccttaggtgatccacctgcctcagcctcccaaagtgctgggattacaggcgtgagccactgtgcctggcttaatttttgtatttttagtggaggtggggtttcaccatgttagtcaggctggtctcgaactcctgagctcaggtgatccacccacctcagcctcccaaactgctggaattataggcgtgagccaccgcgcctgcccccagtttatgttttcacagctgccactaagtttgggatatgagattgaaaatgacgactcggaattttcctgagagagaagtaccctgtgatgtagaagtggaaagattcacaagggaagttccctgcttgtccagtttaggtgatggttgggactgtgagaaccaggagggacacttgaggcaatcagctttaactctggagaaaccagggactcaggaagcaatttgtgaatatcctggttttggggagcatttgattgcaagctcagaccttccaccgtctcagagagttctggcaacaaatggtttccatgcacctgactcaaatgttagtggtctggattgtgaccccgccttacccagctatcctaaaagttatgcagataagagaactggtgacagtgatgcctgtggaaaaggcttcaaccattccatggaagttattcatggaagaaatccagtgagagagaagccctacaaataccctgaaagtgttaagtcttttaatcattttacctctcttggtcatcagaaaataatgaaaagaggcaagaaatcgtatgaaggtaagaattttgagaacatctttactctgagctcatcgcttaatgaaaaccagagaaatctccctggagagaaacaatatagatgtactgaatgtggcaaatgcttcaaacggaactcttctcttgttttgcatcaccgaactcacaccggagagaagccttatacttgtaatgagtgtggaaagtccttctccaagaactacaacctgattgtgcatcaaagaatccacacaggagagaagccctatgaatgcagtaaatgtgggaaagctttcagtgatggctcagctctgacacagcaccagagaattcacacaggcgagaaaccttatgaatgcctagagtgtggaaaaaccttcaaccgaaattcatccttaattttgcaccaaagaactcatacaggggaaaaaccatatagatgtaacgaatgtgggaaacccttcactgacatctcccaccttacagtgcatctcagaatccacaccggtgagaagccctatgagtgtagcaaatgtggaaaggctttccgggacggctcgtacctcacccagcatgagaggactcacactggagaaaagccctttgagtgtgcagagtgcgggaaatccttcaacagaaactctcacctcattgtgcatcaaaagatccattctggggagaaaccctatgaatgtaaagaatgtggcaagactttcatcgagagtgcgtacctcatcaggcatcagaggattcatactggcgagaagccctatggctgcaaccagtgtcagaaacttttcaggaatatcgctggcctcattaggcaccagaggactcatactggtgagaagccctatgagtgtaatcagtgtggcaaagccttcagggacagctcctgtctgaccaagcaccagagaattcacactaaggagaccccatatcagtgtccagaatgtgggaagtccttcaagcagaactctcacctggcagtacatcagagactccatagcagggagggtcccagccggtgtcctcagtgtggaaaaatgttccaaaagagctcatcccttgttcgacatcaaagagcacacctgggagagcaacccatggaaacataatggttgggggccacatgagtcttccagttcactctcactcctgtgtttaggaggcgtgtcttagatctgactcctctctggtcagtagaaaagaatcctttaagctatccagtgaattgatgaatgtgagacattgctgagccacactgttaagtctgctcattggggaactccagagacaacttaggatgagggcagaaaagtctttggggatgattcagtctgtaccagacatgacaacacacacactggaatgaaatgtgcaaacatgggggtgacaccacagagagaacctgtgaatgcattcagaacatgattggaatgaagagccctgtagtagggagtttccaccttgtacgtaagcaaacactgaatcaacttttttttttttttcggacagagtctcactgtgcagtggcatgatctccactcacagcaacctctgcctcccaggttcaagcagttctcctgcctcagcctccaaagtagctaggattacaggtgcctgccaccatgcctggctaattttttctatttttagtagagacagggtttcactgtgttggccaggctggtcttgaactcctgacctcatgatccgcccacctcagcctcccaaagtgttgggattacaggcatgagacactgcctggcctgaatcaaccttttttaagtgtaatcagaaagagaggctttggcaggggctcttactgtgttttctgtaacaacaaaggtgtacaatgagagagtccacacagtgctgtactgcacacaccacagaatgtgtgagattttcctgtttgaatgtatgtctgcattatactcctgcaataatgctgaggactcgttgcaggagggcaaactaggtgaataaattacctgtgaatgaacaatgaagtcgttcctcttaagactgaaacaagcaggccagatgtggtggctcacgcctgtaatcctagcactttgggaggccgaggcggccagatcacaaggttaggagttcaagaccagcctggccagcatggtgaaaccccatctctaccaaaaatacaggaaattatctgggcatagtagtgtgtgcctgtaatcccagctacttgggaagctgaggcaggagaattgcttgaacctgggaggtggaggttgcagtgagctaagatcgcaccactgcactccagcctgggtgacagagcgagactccatttcaaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttggggactggaattttgtatcatatttttttctctgttacagatacttgttggcataataatttggtaataaattaaaaagtgaagcc

SEQ ID NO: 202155 - DNA, 469 bp, Homo sapiens
  Payload ID: 19878
  Gene Name: zinc finger protein 329
  ENST ID: ENST00000601887
  CDS Start-End: 342-469
gatgacctgcactccccaaaccactgcgggatagaacggggccgagtgctctcaggggtggccgctaccggggcggcccgagacacggctgcgggttccagccaacaggcccggagtcgcggcctcggctccgccgtgggtgcacgggctagggctgcggggactcctgtgggctccgcgtctgcggctgggaggaatggggatcgtccccagatcccgccttccgggcagggcctccgctgcctgcgatcctgcccacagtccaaggatcctcctcgcctctcgcggactgcggtgtcagccgcccgagccgttccccggacacctggccagtttgggatatgagattgaaaatgacgactcggaattttcctgagagagaagtaccctgtgatgtagaagtggaaagattcacaagggaagttccctgcttgtccagtttaggtgatggttgggactgtgagaacca

SEQ ID NO: 202156 - DNA, 1899 bp, Homo sapiens
  Payload ID: 19879
  Gene Name: zinc finger protein 330
  Uniprot ID: Q9Y3S2
  ENST ID: ENST00000262990
  CDS Start-End: 229-1191
aaggcgctgctgtcgtaaaaggacgtccggtccgtctcctagtgtccggaatcggctgtcagcctccctggctgttagtaccttctttcccggagtcctggtccacgagttggatttactgctgtcgcgggtgggcctcacgccattccctgtccctcggccccctgagtgagtccggtctcccggcgaaagtgagcgaggtttgcccggagcgcgcacgaggggaaaatgcctaaaaaaaagactggtgcgaggaagaaggctgagaaccgccgagaacgtgaaaaacaactaagagcatcaagaagcactatagatttagctaaacatccatgtaatgcctcaatggaatgtgacaagtgtcagaggcggcagaagaatagagcattttgctacttttgtaattctgtacagaagttaccaatttgtgcacagtgtgggaaaacaaagtgcatgatgaagtcttcagactgtgtcataaagcatgctggtgtatacagtactggccttgcaatggtgggtgcaatatgtgacttctgtgaagcttgggtttgccatggtaggaaatgtctcagtacacatgcttgtgcctgccctcttaccgatgctgagtgtgttgaatgtgaacgaggcgtgtgggaccatggaggcagaatattcagttgttctttttgccataactttctctgtgaagatgatcaatttgagcatcaagccagctgccaggttttagaggcagaaacatttaaatgtgtttcatgcaatcggcttggtcagcactcatgtctccgttgtaaggcttgtttctgtgatgatcatacaaggagcaaagtgtttaagcaagaaaaaggaaaacagcctccttgtcctaaatgtgggcatgaaactcaggagactaaggaccttagcatgtcaacacgctccctgaaatttggcaggcagactggaggtgaagagggagatggagcttctgggtatgatgcttattggaagaacctttcatctgataagtatggtgataccagctaccacgatgaggaggaggatgagtatgaagcagaggatgatgaagaggaagaagatgaaggcagaaaggattcagatactgagtcatcagatttgtttactaatttgaatttaggaaggacctatgctagtggctatgctcactatgaggaacaagagaactaggggagctgctctggtggccgtgtgtgagaggagcaggagtgagtgtgtgtgcttgatgaattgtgtgtggttgttcaaaagtaccttagccacttagccttgtgcagaagactagttacacttaatgggccaagcaatagggtgtagcgtttttatagaactgataatcaggcttatggcataagaaaaatgagtttcaaatttaagatgtttattgatcgaagcaattgaagtatcatggattggattgttactgatttcagtaaagtatgttttgccaattagatacatatatacaagataaaggaataggatggtaatatatttgtttgaaattaaattactgtttttattaaaaaatactgcttcattgggctgattttgtaaaatgtaatgagtaaaatgaattactgtatttttccttttatgtccacagaatgagagtcatatgttgttatattctaaattttcattaaatattcatgtcaccttgagttgtcatgataagtatgttttagtatttgacttattcttctctttcttcacaatgtatgtcctcagtggtacctattattgatgccttaaatgtattgataaggtgactagttagccatttttcagagatacagtatcagaaatagtattattacagaagctttacccaggacattttatttctctttgaataaatctattatttcacttaaa

SEQ ID NO: 202157 - DNA, 552 bp, Homo sapiens
  Payload ID: 19879
  Gene Name: zinc finger protein 330
  ENST ID: ENST00000512738
  CDS Start-End: 94-552
gtccggaatcggctgtcagcctccctggctgttagtaccttctttcccggagtcctggtccacgagttggatttactgctgtcgcgggggaaaatgcctaaaaaaaagactggtgcgaggaagaaggctgagaaccgccgagaacgtgaaaaacaactaagagcatcaagaagcactatagatttagctaaacatccatgtaatgcctcaatggaatgtgacaagtgtcagaggcggcagaagaatagagcattttgctacttttgtaattctgtacagaagttaccaatttgtgcacagtgtgggaaaacaaagtgcatgatgaagtcttcagactgtgtcataaagcatgctggtgtatacagtactggccttgcaatggtgggtgcaatatgtgacttctgtgaagcttgggtttgccatggtaggaaatgtctcagtacacatgcttgtgcctgccctcttaccgatgctgagtgtgttgaatgtgaacgaggcgtgtgggaccatggaggcagaatattcagttgttctttttgccataactttctc

SEQ ID NO: 202158 - DNA, 836 bp, Homo sapiens
  Payload ID: 19879
  Gene Name: zinc finger protein 330
  ENST ID: ENST00000507532
  CDS Start-End: 216-323
cgtaaaaggacgtccggtccgtctcctagtgtccggaatcggctgtcagcctccctggctgttagtaccttctttcccggagtcctggtccacgagttggatttactgctgtcgcgggtgggcctcacgccattccctgtccctcggccccctgagtgagtccggtctcccggcgaaagtgagcgaggtttgcccggagcgcgcacgaggggaaaatgcctaaaaaaaagactggtgcgaggaagaaggctgagaaccgccgagaacgtgaaaaacaactaagagcatcaagaagcactatagatttagctaaacatccatgaatgtgacaagtgtcagaggcggcagaagaatagagcattttgctacttttgtaattctgtacagaagttaccaatttgtgcacagtgtgggaaaacaaagtgcatgatgaagtcttcagactgtgtcataaagcatgctggtgtatacagtactggccttgcaatggtgggtgcaatatgtgacttctgtgaagcttgggtttgccatggtaggaaatgtctcagtacacatgcttgtgcctgccctcttaccgatgctgagtgtgttgaatgtgaacgaggcgtgtgggaccatggaggcagaatattcagttgttctttttgccataactttctctgtgaagatgatcaatttgagcatcaagccagctgccaggttttagaggcagaaacatttaaatgtgtttcatgcaatcggcttggtcagcactcatgtctccgttgtaaggcttgtttctgtgatgatcatacaaggagcaaagtgtttaagcaagaaaaaggaaaacagcctcc

SEQ ID NO: 202159 - DNA, 838 bp, Homo sapiens
  Payload ID: 19879
  Gene Name: zinc finger protein 330
  ENST ID: ENST00000512809
  CDS Start-End: 151-838
gtccggtccgtctcctagtgtccggaatcggctgtcagcctccctggctgttagtaccttctttcccggagtcctggtccacgagttggatttactgctgtcgcgggtgggcctcacgccattccctgtccctcggccccctgagggaaaatgcctaaaaaaaagactggtgcgaggaagaaggctgagaaccgccgagaacgtgaaaaacaactaagagcatcaagaagcactatagatttagctaaacatccatgtaatgcctcaatggaatgtgacaagtgtcagaggcggcagaagaatagagcattttgctacttttgtaattctgtacagaagttaccaatttgtgcacagtgtgggaaaacaaagtgcatgatgaagtcttcagactgtgtcataaagcatgctggtgtatacagtactggccttgcaatggtgggtgcaatatgtgacttctgtgaagcttgggtttgccatggtaggaaatgtctcagtacacatgcttgtgcctgccctcttaccgatgctgagtgtgttgaatgtgaacgaggcgtgtgggaccatggaggcagaatattcagttgttctttttgccataactttctctgtgaagatgatcaatttgagcatcaagccagctgccaggttttagaggcagaaacatttaaatgtgtttcatgcaatcggcttggtcagcactcatgtctccgttgtaaggcttgtttctgtgatgatcatacaaggagcaaagtgtttaagcaagaaaaaggaaaacagcctccttgtcctaaatgtgggcatgaaactcaggagactaaggaccttagcatgtcaa

SEQ ID NO: 202160 - DNA, 573 bp, Homo sapiens
  Payload ID: 19879
  Gene Name: zinc finger protein 330
  ENST ID: ENST00000503649
  CDS Start-End: 155-573
gtccggaatcggctgtcagcctccctggctgttagtaccttctttcccggagtcctggtccacgagttggatttactgctgtcgcgggtgggcctcacgccattccctgtccctcggccccctgagtgagtccggtctcccggcgaaagggaaaatgcctaaaaaaaagactggtgcgaggaagaaggctgagaaccgccgagaacgtgaaaaacaactaagagcatcaagaagcactatagatttagctaaacatccatgtaatgcctcaatggaatgtgacaagtgtcagaggcggcagaagaatagagcattttgctacttttgtaattctgtacagaagttaccaatttgtgcacagtgtgggaaaacaaagtgcatgatgaagtcttcagactgtgtcataaagcatgctggtgtatacagtactggccttgcaatggtgggtgcaatatgtgacttctgtgaagcttgggtttgccatggtaggaaatgtctcagtacacatgcttgtgcctgccctcttaccgatgctgagtgtgttgaatgtgaacgaggcgtgtgggaccatgg

SEQ ID NO: 202161 - DNA, 558 bp, Homo sapiens
  Payload ID: 19879
  Gene Name: zinc finger protein 330
  ENST ID: ENST00000515453
  CDS Start-End: 188-313
gtgtccggaatcggctgtcagcctccctggctgttagtaccttctttcccggagtcctggtccacgagttggatttactgctgtcgcgggtgggcctcacgccattccctgtccctcggccccctgagtgagtccggtctcccggcgaaagtgagcgaggtttgcccggagcgcgcacgaggggaaaatgcctaaaaaaaagactggtgcgaggaagaaggctgagaaccgccgagaacgtgaaaaacaactaagagcatcaagaagcactatagatttagctaaacatccatgtaatgcctcaatggactaagaggtgataaagttggctgtgtgtggaaggggtacacttcacagaagaggtgggattttcaccagaactttcaacaggtaggaggcacttttcagggaaaagtgttcgaataagtaaagacatggagaagagagaatataagacatatttggagaatggctgaccattagtgacttgagtctaaaaagaataggccaagaaggtttggaaagtgattaggggccagattgtggagagcttttaaa

SEQ ID NO: 202162 - DNA, 1180 bp, Homo sapiens
  Payload ID: 19879
  Gene Name: zinc finger protein 330
  ENST ID: ENST00000506302
  CDS Start-End: 182-415
ggaatcggctgtcagcctccctggctgttagtaccttctttcccggagtcctggtccacgagttggatttactgctgtcgcgggtgggcctcacgccattccctgtccctcggccccctgagtgagtccggtctcccggcgaaagtgagcgaggtttgcccggagcgcgcacgaggggaaaatgcctaaaaaaaagactggtgcgaggaagaaggctgagaaccgccgagaacgtgaaaaacaactaagagcatcaagaagcactatagatttagctaaacatccatgtaatgcctcaatggaatgtgacaagtgtcagagggaaaacaaagtgcatgatgaagtcttcagactgtgtcataaagcatgctggtgtatacagtactggccttgcaatggtgggtgcaatatgtgacttctgtgaagcttgggtttgccatggtaggaaatgtctcagtacacatgcttgtgcctgccctcttaccgatgctgagtgtgttgaatgtgaacgaggcgtgtgggaccatggaggcagaatattcagttgttctttttgccataactttctctgtgaagatgatcaatttgagcatcaagccagctgccaggttttagaggcagaaacatttaaatgtgtttcatgcaatcggcttggtcagcactcatgtctccgttgtaaggcttgtttctgtgatgatcatacaaggagcaaagtgtttaagcaagaaaaaggaaaacagcctccttgtcctaaatgtgggcatgaaactcaggagactaaggaccttagcatgtcaacacgctccctgaaatttggcaggcagactggaggtgaagagggagatggagcttctgggtatgatgcttattggaagaacctttcatctgataagtatggtgataccagctaccacgatgaggaggaggatgagtatgaagcagaggatgatgaagaggaagaagatgaaggcagaaaggattcagatactgagtcatcagatttgtttactaatttgaatttaggaaggacctatgctagtggctatgctcactatgaggaacaagagaactaggggagctgctctggtggccgtgtgtgagaggagcaggagtgagtgtgtgtgcttgatgaattgtgtgtggttgttcaaaagtaccttagccacttagccttgtgcag

SEQ ID NO: 202163 - DNA, 5042 bp, Homo sapiens
  Payload ID: 19880
  Gene Name: zinc finger protein 331
  Uniprot ID: Q9NQX6
  ENST ID: ENST00000253144
  CDS Start-End: 1334-2725
ggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagggaagtgggagtgtgtgtgagtgtgtgtgtgtgtgtgtgtgtgtgtgtgtgaataagccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctggtggggtctgcagaggtggcacggccaggacgggtctccgtgtctctgaaatgtgcctttgcacttctgtcaggttgacagggacaggcagtgtccctctggtgtgagcgtctgtgggtgtgaaagggccagcgagtgtgcggctgtgactggtcgggatcgggcctgggtgcatggccttttgagtgagcacaggtgtgtgcgaccatgtcacctgtctttctagtgtctccgttgcttcctgtgccttggccttccagccatgtggtacctgctagggagcagtggtcccaaagtgacgtgagaggctctacgctattgtgaaaatgaccaagaagaaggcttcacaagtcacgagatggcagttttggagccagaagtgctctccgtgcacactacctggacgacaagaggaagtaacctcaagaatagaattccttttggggaagaaagagctggccttcaggaaaagcatcccggaggaggaagaagaagtgttatatgtcctaaagtaaggtttcaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaaaagaaaagaaaaaaatcatatactgaggttgctaagatctacatgacaataagatattttgggagagagatacgttcacataattttattacatatattgttacaattgttctattttgttagttactgttggtaatctcttactgtgcctaatttataaattaaactttagatatgtatgtacaggaaaaaatgtagtatatagtatcgtatatatgtacaggaaaaaaacgtactatctgtggtttcaggtgtccactgcgggtcttcaaacgtacccccctcaggtgagaggggactgctgtacaaagaatataggaaggcctctagactacatccattccttcctcaacaggaggaaaattcctggtacagtttaacgtaaggcttcactgatcactgttgtttttgtttttgtttttgtttttttgagacagagtctcactcttgcccaggctggagtgcagtggcacggtcttggctcactgcaacctccacctcccaggttccagcaattctcctgcctcagcctccccagtagctgggattacagacatgcaccaccacacctggctaatttttgtatttttagtagagacagttttcaccatgttgtccaggctggtctcaactcctgacctcaggtgatccacccaccttgccctcccaaagtgctaggattacaggcgtgagccactgcacctagcccactgatcactcttctgcttacagaatatcagaagtcattctagaggcaaatttgaagagtggaaaaatcactttttctgaatgatcttgtttttggtgtagatgtttttattgtgtgggttagtttaatgaatacataaagactaccagtaccattctgtctttactccgtggcatctgtggaataaccctgctaatgtaacacgtgagaaagcctttggtcatgccacccactctaccagttgtccccaccatcccccgccctcctccctgtgagacactgggccaaaggctcactacccctgtgcgttgtccagcacacagacactatgtgcattatttgtacataaggataatcacatctacctgagactgctatcatggaaattaaatgtttggtacatgtaaagtctttgaaagtgtaactggaatattgtgtaattttaataaataataactattgttgtttttatgatcattactaccatttgtgttgccattagtgaatttttacaagaaaactccctgtgggtgcaatgagtctggaaaagaccattgagtcttctagaagaaaacattaagagattattggcacagccgtgggttacgcaatgatttcttagtacacaaaacacagcaaacataaaaagttgttacacttcatcaaaagtacaaagttctgttcatcaaatgatgctgttaagatagggaaaagacaagaaacaggactggaagaagatgtttgctctaaggtacacctgacaaaggaactctcatagaaaatataaagaatccctcaagttgaaaaaaaaatcaatttaaaggggagaaaacttcagcacgtctcaacagaagaccaccaaatggccaataagtaagtgaaaatgtattcaatgtcattgctcctcaaggaactgtagagtaaaaccacaatgtgctgtcactctagacagtcaccaggatgattaaatttaaatcacaataacaaggctgatttcagatgtctcaccacaaagaaggaggataagggagcgaggtgatggatatgttaattagcttgatttaatccttccacattgtatacatgtatcagaacatcacattgtactccatcaatataatacaattattatttgtcaatcaaatattaataaaatcaaagatgagcagg

SEQ ID NO: 202164 - DNA, 2248 bp, Homo sapiens
  Payload ID: 19880
  Gene Name: zinc finger protein 331
  Uniprot ID: Q9NQX6
  ENST ID: ENST00000411977
  CDS Start-End: 423-1814
gcggccgctgggtgcgcgtgcgcatgcgcgctggcctccagggggtggcgggaccgagtgtgtgacgcacttgcgtgggagtacgaggctgacgcggcggccctgtccccgtaactgtgacacgggtgcacgcgagcgtcattgggggcgatgggggccgtgctgggtgcgcgtttgcaccagtgacgcagccgctgcatctccgccagtccgcgcaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaactt

SEQ ID NO: 202165 - DNA, 3817 bp, Homo sapiens
  Payload ID: 19880
  Gene Name: zinc finger protein 331
  Uniprot ID: Q9NQX6
  ENST ID: ENST00000449416
  CDS Start-End: 109-1500
gttttaccagtgaggaaactttaccacactgtgaactctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaaaagaaaagaaaaaaatcatatactgaggttgctaagatctacatgacaataagatattttgggagagagatacgttcacataattttattacatatattgttacaattgttctattttgttagttactgttggtaatctcttactgtgcctaatttataaattaaactttagatatgtatgtacaggaaaaaatgtagtatatagtatcgtatatatgtacaggaaaaaaacgtactatctgtggtttcaggtgtccactgcgggtcttcaaacgtacccccctcaggtgagaggggactgctgtacaaagaatataggaaggcctctagactacatccattccttcctcaacaggaggaaaattcctggtacagtttaacgtaaggcttcactgatcactgttgtttttgtttttgtttttgtttttttgagacagagtctcactcttgcccaggctggagtgcagtggcacggtcttggctcactgcaacctccacctcccaggttccagcaattctcctgcctcagcctccccagtagctgggattacagacatgcaccaccacacctggctaatttttgtatttttagtagagacagttttcaccatgttgtccaggctggtctcaactcctgacctcaggtgatccacccaccttgccctcccaaagtgctaggattacaggcgtgagccactgcacctagcccactgatcactcttctgcttacagaatatcagaagtcattctagaggcaaatttgaagagtggaaaaatcactttttctgaatgatcttgtttttggtgtagatgtttttattgtgtgggttagtttaatgaatacataaagactaccagtaccattctgtctttactccgtggcatctgtggaataaccctgctaatgtaacacgtgagaaagcctttggtcatgccacccactctaccagttgtccccaccatcccccgccctcctccctgtgagacactgggccaaaggctcactacccctgtgcgttgtccagcacacagacactatgtgcattatttgtacataaggataatcacatctacctgagactgctatcatggaaattaaatgtttggtacatgtaaagtctttgaaagtgtaactggaatattgtgtaattttaataaataataactattgttgtttttatgatcattactaccatttgtgttgccattagtgaatttttacaagaaaactccctgtgggtgcaatgagtctggaaaagaccattgagtcttctagaagaaaacattaagagattattggcacagccgtgggttacgcaatgatttcttagtacacaaaacacagcaaacataaaaagttgttacacttcatcaaaagtacaaagttctgttcatcaaatgatgctgttaagatagggaaaagacaagaaacaggactggaagaagatgtttgctctaaggtacacctgacaaaggaactctcatagaaaatataaagaatccctcaagttgaaaaaaaaatcaatttaaaggggagaaaacttcagcacgtctcaacagaagaccaccaaatggccaataagtaagtgaaaatgtattcaatgtcattgctcctcaaggaactgtagagtaaaaccacaatgtgctgtcactctagacagtcaccaggatgattaaatttaaatcacaataacaaggctgatttcagatgtctcaccacaaagaaggaggataagggagcgaggtgatggatatgttaattagcttgatttaatccttccacattgtatacatgtatcagaacatcacattgtactccatcaatataatacaattattatttgtcaatcaaatattaataaaatcaaagatgagcagg

SEQ ID NO: 202166 - DNA, 2120 bp, Homo sapiens
  Payload ID: 19880
  Gene Name: zinc finger protein 331
  Uniprot ID: Q9NQX6
  ENST ID: ENST00000511154
  CDS Start-End: 295-1686
acgcacttgcgtgggagtacgaggctgacgcggcggccctgtccccgtaactgtgacacgggtgcacgcgagcgtcattgggggcgatgggggccgtgctgggtgcgcgtttgcaccagtgacgcagccgctgcatctccgccagtccgcgcaggccagcatccttcagaaaaagcatccccgaggaggaagacgaatcgttaaacatctgaaagggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaactt

SEQ ID NO: 202167 - DNA, 2130 bp, Homo sapiens
  Payload ID: 19880
  Gene Name: zinc finger protein 331
  Uniprot ID: Q9NQX6
  ENST ID: ENST00000512387
  CDS Start-End: 302-1693
gactgtgtgacgcacttgcgtgggagtgcgaggctgacgcggcggctctatctcccgtaactgtgacacgggtgcacgcaagcgtcattgggggtgatgggggccgtgctcggtgcgcttctgcaccggtgacgcaaccgctgtgtctccgccagtccgcgcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaa

SEQ ID NO: 202168 - DNA, 913 bp, Homo sapiens
  Payload ID: 19880
  Gene Name: zinc finger protein 331
  ENST ID: ENST00000514022
  CDS Start-End: 414-913
gtcattgggggtgatgggggccgtgctcggtgcgcttctgcaccggtgacgcaaccgctgtgtctccgccagtccgcgcaggtgagattggcgcccatggctccaaggggagacgggcacggagcttctagcggtgacgcacttgctggagagggtgtggggtgacgcagccgggctctccccataactagggctggggtgctcccgaggctttggggcgacggaacccgcacctgtgaacctcggcagtgcgtccccgggactctgttctgtgaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggc

SEQ ID NO: 202169 - DNA, 573 bp, Homo sapiens
  Payload ID: 19880
  Gene Name: zinc finger protein 331
  ENST ID: ENST00000502616
  CDS Start-End: 317-573
ggtgatcgggccttctgggtgacgcaggtgtgtgtgacagcacaacctgtagttccagcgtctctgtgctgagatgggtgatcgggccttctgggtgacgcaggtgtgtgtgacaacacaacctgtagctccagcttctctgtgctgggatggatgatcgggccttctgggtgacgcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtga

SEQ ID NO: 202170 - DNA, 1890 bp, Homo sapiens
  Payload ID: 19880
  Gene Name: zinc finger protein 331
  Uniprot ID: Q9NQX6
  ENST ID: ENST00000513999
  CDS Start-End: 370-1761
aggtgtgtgtgacagtgcaacttgtagctccagcgtctctgctgcttcccctgccttcacctcctaaccaagcggtacctgcctgagaacaagggccgcggagggacgtgagcgcctgagcctcgcctggaaattcaccagcaagaaggcagaaacagccatgaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaa

SEQ ID NO: 202171 - DNA, 670 bp, Homo sapiens
  Payload ID: 19880
  Gene Name: zinc finger protein 331
  ENST ID: ENST00000509047
  CDS Start-End: 411-670
agtccgcgcaggtgagattggtgcgcgtggctccgaggggagacgggcacggggcttctgacggtgacgcacttgctggagagtgtggggtgacacagccgggctctccccataactggtgaccgggggtgctccagaggctttgggtcaacgcagcccgtgcctgtgaacctcggcggtgcgtccctgggactctgctccgtgaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaagg

SEQ ID NO: 202172 - DNA, 670 bp, Homo sapiens
  Payload ID: 19880
  Gene Name: zinc finger protein 331
  ENST ID: ENST00000502248
  CDS Start-End: 481-670
gtcacctgtctttctagtgtctccgttgcttcctgtgccttggccttccagccatgtggtacctgctagggagcagtggtcccaaagtgacgtgagaggctctacgctattgtgaaaatgaccaagaagaaggcttcacaagtcacgagatggcagttttggagccagaagtgctctccgtgcacactacctggacgacaagaggaagtaacctcaagaatagaattccttttggggaagaaagaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatg

SEQ ID NO: 202173 - DNA, 574 bp, Homo sapiens
  Payload ID: 19880
  Gene Name: zinc finger protein 331
  ENST ID: ENST00000514374
  CDS Start-End: 276-574
ttcccccgacggccccgcgtcctcttctagcctcaccctctcccgaggccccagcgttgggggactaccgggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgt

SEQ ID NO: 202174 - DNA, 688 bp, Homo sapiens
  Payload ID: 19880
  Gene Name: zinc finger protein 331
  ENST ID: ENST00000505426
  CDS Start-End: 496-688
agcggtacctgcctgagaacaagggccgcggaaggacgggagtgcctgagccctgccaggaaattcaccaacaagaaggcagaaacagccatgaggtgacgctttcagagctagaagtgctctccactcagggcgcctgagtgacaggagacggtggcctcaggagtagaattcctcctgtagagggacacgtccctgatgtgggagacagggagaggggcagctccacgcttcatcatctcagttaccacagcgtgctcttcaggaatctcccagaaactccatctcggggcctcgtatttctcattggttttattaggtatggcaggtgttacccttctggttctgttttccccaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaa

SEQ ID NO: 202175 - DNA, 641 bp, Homo sapiens
  Payload ID: 19880
  Gene Name: zinc finger protein 331
  ENST ID: ENST00000504493
  CDS Start-End: 443-641
gctgagatgggtgatcgggccttctgggtgacgcaggtgtgtgtgacaacacaacctgtagctccagcttctctgtgctgggatggatgatcgggccttctgggtgacgcaggtgtgtgtgacagcacaacctgtagctccagcgtctctgctgcttcccctgccttcacctcctaaccaagcggtacctgcctgagaacaagggccgcggaaggacgggagtgcctgagccctgccaggaaattcaccaacaagaaggcagaaacagccatgaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataaggg

SEQ ID NO: 202176 - DNA, 540 bp, Homo sapiens
  Payload ID: 19880
  Gene Name: zinc finger protein 331
  ENST ID: ENST00000511567
  CDS Start-End: 226-540
gtgcacgcaagcgtcattgggggtgatgggggccgtgctcggtgcgcttctgcaccggtgacgcaaccgctgtgtctccgccagtccgcgcaggccagcatccttcagaaaaagcatccccgaggaggaagacgaatcgttaaacatcttagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatc

SEQ ID NO: 202177 - DNA, 562 bp, Homo sapiens
  Payload ID: 19880
  Gene Name: zinc finger protein 331
  ENST ID: ENST00000509585
  CDS Start-End: 422-562
ggtgcgcgtggctccgaggggagacgggcacggggcttctgacggtgacgcacttgctggagagtgtggggtgacacagccgggctctccccataactggtgaccgggggtgctccagaggctttgggtcaacgcagcccgtgcctgtgaacctcggcggtgcgtccctgggactctgctccgtgaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttg

SEQ ID NO: 202178 - DNA, 739 bp, Homo sapiens
  Payload ID: 19880
  Gene Name: zinc finger protein 331
  ENST ID: ENST00000513265
  CDS Start-End: 200-496
ggggcgacggaacccgcacctgtgaacctcggcagtgcgtccccgggactctgttctgtgaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatcca

SEQ ID NO: 202179 - DNA, 1985 bp, Homo sapiens
  Payload ID: 19880
  Gene Name: zinc finger protein 331
  Uniprot ID: Q9NQX6
  ENST ID: ENST00000511593
  CDS Start-End: 465-1856
tgtctccgttgcttcctgtgccttggccttccagccatgtggtacctgctagggagcagtggtcccaaagtgacgtgagaggctctacgctattgtgaaaatgaccaagaagaaggcttcacaagtcacgagatggcagttttggagccagaagtgctctccgtgcacactacctggacgacaagaggaagtaacctcaagaatagaattccttttggggaagaaagagctggccttcaggaaaagcatcccggaggaggaagaagaagtgttatatgtcctaaagtaaggtttcaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaa

SEQ ID NO: 202180 - DNA, 761 bp, Homo sapiens
  Payload ID: 19880
  Gene Name: zinc finger protein 331
  ENST ID: ENST00000505949
  CDS Start-End: 230-761
ggggcgacggaacccgcacctgtgaacctcggcagtgcgtccccgggactctgttctgtgaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatc

SEQ ID NO: 202181 - DNA, 4672 bp, Homo sapiens
  Payload ID: 19881
  Gene Name: zinc finger protein 333
  Uniprot ID: Q96JL9
  ENST ID: ENST00000292530
  CDS Start-End: 92-2089
gcggcgcggtgcggcacggcacggtgggagtgtctccggctggcttgcagggagaacaccgactgagacctcaaaccctggctccagtgtcatggaatccgtcacctttgaggatgtggccgtggagttcatccaggagtgggcattgctggacagcgcacggaggagcctgtgcaaatacaggatgcttgaccagtgcaggaccctggcctccaggggaactccaccatgcaaacccagttgtgtctcccagctggggcaaagagcagagccaaaggcaacagaacgagggattctccgtgccacaggtgttgcctgggaatctcaacttaaacccgaagagttgccttctatgcaggatcttttggaagaagcatcctccagggacatgcaaatggggccggggctgttcctgaggatgcagctggtgccctccatagaagagagggagacaccattgactcgagaggaccggccagctctccaggagccgccttggtctctgggatgcacgggactgaaggccgctatgcagattcagagggtggtgataccagtgcctactctgggccaccgcaacccatgggtggccagggattctgctgtgcctgcacgtgaccctgcctggcttcaggaggacaaagtggaggaagaagctatggctcctgggctgccaaccgcctgttcacaggaaccagtcacctttgcagatgtggctgtggtgttcaccccagaagaatgggtgtttctggactctactcagaggagcctgtatagagatgtgatgctggagaactacaggaacctggcctctgtggctgatcaactgtgcaaacccaatgcgttgtcttatttggaagaaagaggagagcagtggaccactgacaggggcgtcctctcagacacctgtgcagaacctcagtgtcaaccccaagaggcaattcctagccaagatacttttacagagatcctgtccattgatgtgaaaggggagcaacctcagcctggagaaaaactctataaatataatgaacttgagaaaccttttaacagcattgaaccacttttccagtaccagagaattcatgctggagaggcatcctgtgaatgtcaagagattagaaattccttcttccagagtgcccacctaattgtgcccgagaaaatccgtagtggggataaatcctatgcatgtaacaaatgtgaaaaatccttcagatacagctctgaccttatcaggcatgagaagactcatactgcagagaagtgctttgactgtcaagaatgtgggcaagccttcaaatattcctcgaatctccggcgacacatgagaacccataccggagagaagccatttgaatgtagtcagtgtgggaaaaccttcacgaggaactttaacctgattttgcaccagagaaaccacacaggagagaagccctacgagtgtaaagattgtgggaaagccttcaatcagccatcatccctcaggagccacgtgagaactcacactggagagaagccctttgaatgcagccagtgtgggaaagccttcagggaacactcttcactgaagacacatctgcgaacccataccagagagaaaccatatgaatgcaaccagtgtggcaagcccttccggacgagcactcatctgaacgtgcacaagaggatacacacaggggagaaactgtatgagtgcgcgacttgcggtcaggtcttgagtcgtctttcaaccctgaagagtcacatgcgaactcacactggagagaagccctatgtgtgccaggaatgtgggcgagccttcagtgagccctcatccctcaggaaacatgcaaggactcacagtggcaagaagccctatgcatgccaggaatgcgggcgagcctttggtcagtcttcacatcttattgtacatgtgagaacacacagtgccgggagaccctatcaatgtaatcagtgtgagaaagccttcaggcacagctcctcactcactgtacacaaaagaacccatgtgggaagagagaccattaggaatggcagcctgcctttatccatgtctcatccatactgtgggccccttgctaattaacttccattttgtaaaaatataaacacatggggctatgactttccctcgtaatactcctttagctgcatcctgtgtttcaatgtataatattttcattttggtttaattgtaagtattgtcttaacctccattatcgtttattctttgacccatctattatttggaattagatttttcaaaactaatatgtggatatattttcatagaggtataatgacttatagtgaaatgcatacatctgaagtgtacagttggatgagtttgacagatgcatacatgcatgtaaccaccaccccattccagatatagaatgtttctatctctctggaaggttcctgcatgttatatggctatttcttagttgcctttttgttgttggtttctaatttaattacatggtgagaagagtatgtggcctctttgttactgagtcataggtatttgctgagatttgctattaggtctggtgtggcttattcttctagctgccaacccaaattaccccttcctccttagaaaagaacctgggttttctgttcagattggcagtgtgcactattaaaaagcttccatctcccggctgggcacggtggctcatgcctctaatcccagcactttgggaggctgaggctgggggatcacctgaggtcaggagttcgagatcagcctggccaacatggtgaaatcccctctctactaaaaatataaaaattagccaagtttggtggcatgcacctgtaatcccagctacttgggaggctgaggcaggagaattctttgaacccaggaggcagaggttgcagtgagccgagattgcgccactgcactccagcctgggcaacagagtgaaactctgtctcaaaaataataataataaaaaaaagcttccatctcccagcccttcttgcaagcaagggcaggccatttcctccggtcctggctagtatgaatatgagaagtcactggatgtgactctggggaagatattgtgttcagggatggtttcatgtagccacatctctccacttcttgccttttggacaagtagacatgatttctagacctagaggagccctcctgtgaccataagggtaaaagccgcaagctaagaagagggtggccggaagtcataaccatcttgcttctgtaatctaaaaaatatttaggatagatttaatagaattggcatatttatgtgattgcagcagccctggactatttatttctggatgtcccatacatgaaaaatatgcacttcttactggtacagttttcttttgtttgtttttgtttttggtgggaggtttatttcacctgaatataattcctaactgatgcacttagtatatgtcagtttttataaatgcttcatggatggttgaaatcaatgtattgtattctacaaatgtctgctagatcaagcaaatgtgtttaaaaaccatctacacatttataaatgttgatctgtgatctagcatttattgagagaggtatgttaaactctcccaccatgattatgtattgctgaaaaatctttgtcattctgtcagtttttaaatttatgtatatacatacatatatatgttttgaagcaatgaaattaaatatagatactgacattttttacatttccaacaaattgttacttttattcttataaagtgatcatccttttccctattactgaacattcaaccattcattgtaatgatagtaaatacttatttagagtttactattaatagatagtagccactgcctgaagctttgcatcttttaatttagtcctcacactgacactttgaggtatgtactgttatccccaattcccagatgaggaagctgaggcccagcaagttaaggtgggctatcaaagtcatctgggtggcatgtgacaggcctgactctctctacagtggcagacccaggggactagtctccatttttacttgttctttttttttttttttttttttttttggttttaaagttctcttaggtataacttacataaacgttaataaatcttagggtacaccttggtgaattttgtatatgtctatacccaccacggtctccatcaaaatattttatcgtcccagaaatttcccttgggccccacctcatcctcaaaggttatcactattctgatgtctatcaccatagatttgtttttcctgttcatgtaaatggaaccataaacagccctcttgtgtctgttttcttcacttaatatagtgtcattgagatttatctatgttgtattatcagtagtttatgctttttaattgctgtgtaatagtccatagtctgaatataccacaatttaaaaattctattctgtttacaaacatttgagttctgtcctccaggttcatccatgttatcacaaatgacagaatttccttcctcatcaaggctgaatagtattccattgtgtagatataccacattttctttatccattcatccaccgatggacagttaggttgattccatatcttggctattgtgaataatcctgcaggttttattgttatgaataaagctgctgtgaatgttcttgttaagtcatactgtgga

SEQ ID NO: 202182 - DNA, 3595 bp, Homo sapiens
  Payload ID: 19881
  Gene Name: zinc finger protein 333
  Uniprot ID: Q96JL9
  ENST ID: ENST00000540689
  CDS Start-End: 124-1035
cggccgacggcggctgagctgtgctgcgcggcgcggcgcggtgcggcacggcacggtgggagtgtctccggctggcttgcagggagaacaccgactgagacctcaaaccctggctccagtgtcatggaatccgtcacctttgaggatgtggccgtggagttcatccaggagtgggcattgctggacagcgcacggaggagcctgtgcaaatacaggatgcttgaccagtgcaggaccctggcctccaggggaactccaccatgcaaacccagttgtgtctcccagctggggcaaagagcagagccaaaggcaacagaacgagggattctccgtgccacaggtgttgcctgggaatctcaacttaaacccgaagagttgccttctatgcaggatcttttggaagaagcatcctccagggacatgcaaatggggccggggctgttcctgaggatgcagctggtgccctccatagaagagagggagacaccattgactcgagaggaccggccagctctccaggagccgccttggtctctgggatgcacgggactgaaggccgctatgcagattcagagggtggtgataccagtgcctactctgggccaccgcaacccatgggtggccagggattctgctgtgcctgcacgtgaccctgcctggcttcaggaggacaaagtggaggaagaagctatggctcctgggctgccaaccgcctgttcacaggaaccagtcacctttgcagatgtggctgtggtgttcaccccagaagaatgggtgtttctggactctactcagaggagcctgtatagagatgtgatgctggagaactacaggaacctggcctctgtggctgatcaactgtgcaaacccaatgcgttgtcttatttggaagaaagaggagagcagtggaccactgacaggggcgtcctctcagacacctgtgcagaacctcagtgtcaaccccaagaggcaattcctagccaagatacttttacagagatcctgtccattgatgtgaaagggccacccaactaatttggaagaatttccacatccagtactctcttgcatgttcagatcgctagaatccaacctctggatatcaaaggatcactactggggcttgaagactccaaatctgcagattctgaagcttgcaggtcagtggccttggactttcaaacttccagttccgtgacatccgggctccttaacttccggcttccgggagcttagtcacatacttctggcttccggattgtaggttccccgcaaggagactaaggcctgtgtgggtctttgtttccccagccgtgcaatgactgttagatgcagaaagggggaaaacagccagggaaactgctcacagtggacccccacggtggagagctggagggagagggttcttcaaacgtgtaccctagctcctttgtctgctgtctttggtgggcgtggtcttgtacttaaaatccagctgagaagccaaactctaccttaaagccgtatttcatgtttcaaactggatgatataattctggagaaatgagatgggaaactctgctgcctacttgccccttaactcttgtttatctttgggtttcttactacataccagagcttaatctttattttcttacttaatattcaaacacaacccatgagcaaattaacattatttccatcataaataaagagaatggacttaataaatttaaaaagtgaagatatgggggcaaatggatgctgccatcagctgaccctagagtttcctctgaccttccttccccaacctcgtctgtgtttcacttctgccatgtccttaaaggggctgtgtgtcccccagaccacagagtccattgcactgcacctttccttcctcctcattttccatcttacaaatcatcaatattcctggatgtaggatcatgtctgtcttatatgttttagtttctctcaatttagcattatgccttgcacgagagtataggaatacctcatttcattgcccttcacagatattgcattttttacaaattgaacgtttatggcagccctgtgtcgagcaagtctgtaggtgccattttcccaacagcatgtgctcactttgtgtccctgcttgagcattttttaggaataaactatttttaaattaaagtatgtacattaaaaaaaagacataatgctattgcacacattacagtatagggtaagcatacttttatgcacactgggaaaccaaaaaatgtgtatgacttgctttattgcaatattcacattattgtggtgatctggagtggagcctgcaatatctctgaggtgtgtctgtatgtgctcatcacatatgtgatgaatggatgaataaattagtgtagagtgaagtgcttccatgaacctgaacatcatggtctggaaactatgggcagtgagtcaaatctgacccaccatctgtttctgtacagctaagaatagtttttacatttttcaaatgggtgaaaacaaataaaaagaagaatgatattttgtgtcacatgactgatatatgaagttcaagctcagtgtccataaagttttattaaaacatagccatgatcattcatttatgattgtctatagctgttttcatatcacaatggaagttcaagttcagtgtctgtaaagttttattaaaacatagccatgatcattcatttatgattgtctatagctgttttcataccacagtggtagaattgagttgctgtaaatacctggctcacaaagcctaacatatacactatcaggctctttaagaaaacatttggcgacccctgctctaggtagactctatggggatatgggctctacactcatagggacccacatgttccaagcctccagctgtgtgttctgcttcctcaagcagcagctgactctgatattccccatctcaccttagcagtctatatcaagcaaagggcacgcagaatcccatgcacccatcatgtatgtaataaaaggcagatattatgtggtctcttgaaccagccttaggcatggaggttgaggatcaggagtgacttgagggtactgactggcagagcaggagccccgttattttggacaaacaccgccactttaagtttcagcttcatttttagccttctggatttaaggaaattacttttttaaaaactataagcagccaaaaaaagcagacagtaaaatgcagataaaacagctcgggcacagaggaaggtggaggaaaagtctcttgggtaactgccaaacttcaccctcatacaatgggccccagtaaaacagtgggccttaataagcacattcctttccctccaggtgcactaaaatagggaagctaaaagcagacttggggggtatgcctacagctgcagaaaaatgtataaaagcaaacacaccactctccctcccatataagcacaacaaaaaaaacacagaagcagtccaagcctctaagaaactctcccaccctaaatccttaaacactcttagtctgtagaaaagactctaacctaattcagccagcagcccctctcaggtgtgttttctctaaaataaacctgtcttaaccatcaagcca

SEQ ID NO: 202183 - DNA, 4151 bp, Homo sapiens
  Payload ID: 19881
  Gene Name: zinc finger protein 333
  ENST ID: ENST00000598161
  CDS Start-End: 42-629
ggagaacaccgactgagacctcaaaccctggctccagtgtcatggaatccgtcacctttgaggatgtggccgtggagttcatccaggagtgggcattgctggacagcgcacggaggagcctgtgcaaatacaggatgcttgaccagtgcaggaccctggcctccaggggaactccaccatgcaaacccagttgtgtctcccagctggggcaaagagcagagccaaaggcaacagaacgagggattctccgtgccacaggtgttgcctgggaatctcaacttaaacccgaagagttgccttctatgcaggatcttttggaagaagcatcctccagggacatgcaaatggggccggggctgttcctgaggatgcagctggtgccctccatagaagagagggagacaccattgactcgagaggaccggccagctctccaggagccgccttggtctctgggatgcacgggactgaaggccgctatgcagattcagagggtggtgataccagtgcctactctgggccaccgcaacccatgggtggccagggattctggccagaaggaggatgcctggtgcagagcgaggagtggtgttgatttgaaggcaggtgggaaggaagtttctttttaaggcagacttgcaggttggttgtggtttatctgcccttgatttgtggtaagtcctggagcaccactagccctgcagtgtagaggggcagagaaaggggccaggcagccggggaggaaaagctgtcccaaagctgagtcgggacagtggtgggggctgcaggagctttggagtctcctggtgaattatggagtctatggctcttgggatatggaatgaaggcgtgcgtgtgtgtgtgtgtgtgtgtgtgcacgtctatatgtctctttgtgtgctggtctgtgtgtatatgttatatatatgaacaggtgcatgtggtatgtaactgtgtatatgtgtgcgtgtttgtgtgtatatgtgtgcatgtctgtgtacgtgtgtgcatgtgattgcatgcatgcgtgtgcaagagcttgcagatatgtgtctgcatgtgtgtgtccctgtgagtgtgtgcatgtgtgtgtgtacacatgtgatcactcacagccagggtgggcagacttggggcctgtgagtgtgcccagtaggccaggcaccaaccctcatgcctcttcccttctcccctagctgtgcctgcacgtgaccctgcctggcttcaggaggacaaagtggaggaagaagctatggctcctgggctgccaaccgcctgttcacaggaaccagtcacctttgcagatgtggctgtggtgttcaccccagaagaatgggtgtttctggactctactcagaggagcctgtatagagatgtgatgctggagaactacaggaacctggcctctgtggctgatcaactgtgcaaacccaatgcgttgtcttatttggaagaaagaggagagcagtggaccactgacaggggcgtcctctcagacacctgtgcagaacctcagtgtcaaccccaagaggcaattcctagccaagatacttttacagagatcctgtccattgatgtgaaaggggagcaacctcagcctggagaaaaactctataaatataatgaacttgagaaaccttttaacagcattgaaccacttttccagtaccagagaattcatgctggagaggcatcctgtgaatgtcaagagattagaaattccttcttccagagtgcccacctaattgtgcccgagaaaatccgtagtggggataaatcctatgcatgtaacaaatgtgaaaaatccttcagatacagctctgaccttatcaggcatgagaagactcatactgcagagaagtgctttgactgtcaagaatgtgggcaagccttcaaatattcctcgaatctccggcgacacatgagaacccataccggagagaagccatttgaatgtagtcagtgtgggaaaaccttcacgaggaactttaacctgattttgcaccagagaaaccacacaggagagaagccctacgagtgtaaagattgtgggaaagccttcaatcagccatcatccctcaggagccacgtgagaactcacactggagagaagccctttgaatgcagccagtgtgggaaagccttcagggaacactcttcactgaagacacatctgcgaacccataccagagagaaaccatatgaatgcaaccagtgtggcaagcccttccggacgagcactcatctgaacgtgcacaagaggatacacacaggggagaaactgtatgagtgcgcgacttgcggtcaggtcttgagtcgtctttcaaccctgaagagtcacatgcgaactcacactggagagaagccctatgtgtgccaggaatgtgggcgagccttcagtgagccctcatccctcaggaaacatgcaaggactcacagtggcaagaagccctatgcatgccaggaatgcgggcgagcctttggtcagtcttcacatcttattgtacatgtgagaacacacagtgccgggagaccctatcaatgtaatcagtgtgagaaagccttcaggcacagctcctcactcactgtacacaaaagaacccatgtgggaagagagaccattaggaatggcagcctgcctttatccatgtctcatccatactgtgggccccttgctaattaacttccattttgtaaaaatataaacacatggggctatgactttccctcgtaatactcctttagctgcatcctgtgtttcaatgtataatattttcattttggtttaattgtaagtattgtcttaacctccattatcgtttattctttgacccatctattatttggaattagatttttcaaaactaatatgtggatatattttcatagaggtataatgacttatagtgaaatgcatacatctgaagtgtacagttggatgagtttgacagatgcatacatgcatgtaaccaccaccccattccagatatagaatgtttctatctctctggaaggttcctgcatgttatatggctatttcttagttgcctttttgttgttggtttctaatttaattacatggtgagaagagtatgtggcctctttgttactgagtcataggtatttgctgagatttgctattaggtctggtgtggcttattcttctagctgccaacccaaattaccccttcctccttagaaaagaacctgggttttctgttcagattggcagtgtgcactattaaaaagcttccatctcccggctgggcacggtggctcatgcctctaatcccagcactttgggaggctgaggctgggggatcacctgaggtcaggagttcgagatcagcctggccaacatggtgaaatcccctctctactaaaaatataaaaattagccaagtttggtggcatgcacctgtaatcccagctacttgggaggctgaggcaggagaattctttgaacccaggaggcagaggttgcagtgagccgagattgcgccactgcactccagcctgggcaacagagtgaaactctgtctcaaaaataataataataaaaaaaagcttccatctcccagcccttcttgcaagcaagggcaggccatttcctccggtcctggctagtatgaatatgagaagtcactggatgtgactctggggaagatattgtgttcagggatggtttcatgtagccacatctctccacttcttgccttttggacaagtagacatgatttctagacctagaggagccctcctgtgaccataagggtaaaagccgcaagctaagaagagggtggccggaagtcataaccatcttgcttctgtaatctaaaaaatatttaggatagatttaatagaattggcatatttatgtgattgcagcagccctggactatttatttctggatgtcccatacatgaaaaatatgcacttcttactggtacagttttcttttgtttgtttttgtttttggtgggaggtttatttcacctgaatataattcctaactgatgcacttagtatatgtcagtttttataaatgcttcatggatggttgaaatcaatgtattgtattctacaaatgtctgctagatcaagcaaatgtgtttaaaaaccatctacacatttataaatgttgatctgt

SEQ ID NO: 202184 - DNA, 1129 bp, Homo sapiens
  Payload ID: 19881
  Gene Name: zinc finger protein 333
  ENST ID: ENST00000597007
  CDS Start-End: 144-464
agcggaagtgcgcgcggcggcggccgacggcggctgagctgtgctgcgcggcgcggcgcggtgcggcacggcacggtgggagtgtctccggctggcttgcagggagaacaccgactgagacctcaaaccctggctccagtgtcatggaatccgtcacctttgaggatgtggccgtggagttcatccaggagtgggcattgctggacagcgcacggaggagcctgtgcaaatacaggatgcttgaccagtgcaggaccctggcctccaggggaactccaccatgcaaacccagttgtgtctcccagctggggcaaagagcagagccaaaggcaacagaacgagggattctccgtgccacaggtgttgcctgggaatctcaacttaaacccgaagagttgccttctatgcaggatcttttggaagaagcatcctccagggacatgcaaatggtggaccccatgtgaagaaaggagagagggagggagaatgagcaacgagggcccggtgccctctttgtttctgtgggctctctcctttcagtacagggctccagtgccctccacagaactccacacccagcccagcaagcccctccataatgggtgctgagagtggcaggcatggggctcttgttacatcagagccccaggaaacaggcggtcacagactattctgagtgggcagaggaggtccacctatggacacacgtttagagaagctgaggagttcatccctgaagacatccagcccgtgagtagtagaggggccggggctgttcctgaggatgcagctggtgccctccatagaagagagggagacaccattgactcgagaggaccggccagctctccaggagccgccttggtctctgggatgcacgggactgaaggccgctatgcagattcagagggtggtgataccagtgcctactctgggccaccgcaacccatgggtggccagggattctgctgtgcctgcacgtgaccctgcctggcttcaggaggacaaagtggaggaagaagctatggctcctgggctgccaaccgcctgttcacaggaaccagtcacctttgcagatgtggctgtggtgttcaccccagaagaatgggtgtttctggactctactcag

SEQ ID NO: 202185 - DNA, 1392 bp, Homo sapiens
  Payload ID: 19881
  Gene Name: zinc finger protein 333
  ENST ID: ENST00000601134
  CDS Start-End: 119-619
gacggcggctgagctgtgctgcgcggcgcggcgcggtgcggcacggcacggtgggagtgtctccggctggcttgcagggagaacaccgactgagacctcaaaccctggctccagtgtcatggaatccgtcacctttgaggatgtggccgtggagttcatccaggagtgggcattgctggacagcgcacggaggagcctgtgcaaatacaggatgcttgaccagtgcaggaccctggcctccaggggggccggggctgttcctgaggatgcagctggtgccctccatagaagagagggagacaccattgactcgagaggaccggccagctctccaggagccgccttggtctctgggatgcacgggactgaaggccgctatgcagattcagagggtggtgataccagtgcctactctgggccaccgcaacccatgggtggccagggattctgggaacaattcttagatctaagtcttgtgttgctcttcagtatatttttgcgggtaacaccactactgtcatccgatggtgagatggggaccaggaaacagtcacaaagaaaacaccgacccctcctccgtggagctcacggtcagctgggtggtcagagttcgaaatgaataacagagtccagtggaagtgtgttatacaaggacttcatctcaggggacgggagagttctgggaaaggatggatatttaagcttaggccagggtttctcaactgcagcactgctgataatgggctactgcagcactgctgataatgggcctgttcactctcagctgtgggccgtcctgtgcattataggatgctgagcagcatccctggcctcaactcactagatgctacgagcacttttcctctatgagtttgctagggctgccatatcaaagttccaccagctgggtggattaaacagcaaaaatatattgtctcaccgttctggaggccagaagctcgagagcaaggtgttggcagtgttggttccttttgaagcctctccttggtgtgtagatggccatcttctctctatatcttcacatcatcttccctctgtccatgtctgtgtccaaatgtcgtcttcttgtgatagggtttggatttgtgtccccacctaaatctcatgtcaaattgtaatctccagtgttggaggaagggcttggtgggaggtgactggatcatgggggtggacttcccccttgctgttctcttgatagtgagtgagttctcacgagatctggttgtttaaaagtgtgtagcacctcccccttcactctcttcctcctgctccagccatgtagcacgtgcctgcttcccctttgccttccgccatgattgtaagtttctcgagtcctccccagccatgcgtcctgtacaacctgtggaacca

SEQ ID NO: 202186 - DNA, 3890 bp, Homo sapiens
  Payload ID: 19882
  Gene Name: zinc finger protein 334
  Uniprot ID: Q9HCZ1
  ENST ID: ENST00000347606
  CDS Start-End: 184-2226
cttccgggtgagggtcctgcagcccgtgaatccctggtcccgccgagacttggacctggtgcgaactggaggcgaagcgggtgcacccacaacctataggaagggctggcggcgagctctgagcactcgggcgtcggagggaacgctctgctttcaacactcttggccctttctcaagagaacatgaaaatgaaaaaatttcagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtgaactatgaaaatattcaacagcaattcaaaggttatgccaaatgtgcctcccttttaaaataatgaaacaaacattgtttaagttaaattgttacttggttcctccccacagtgttacttgatagtgtatgttacgaggtgtgaggatctgaccttcatttcaaatcaataccattgtttgatagttgagtaagttacagtttctcaatttatggtgtattttcagatttggcagattttttgttgtctgctaactccatagtcttctagtagtggactgtatacctttatctgcaaaggtgacaactcaggagaactaaccattgtactctatgcacccatggtaattataccccaggtgagcattttgtaaagctgagccagtgaaagcccttcctaagacctttctaatggaagataggcacaggataactagttcatgatcctgaagctttcagctaagtcaagaagacggcaattgcagtaggaaaaacatgggaaaataagcattcttgaacaacaaagagaatttggatgatggttgaatccaaaaagtgtttatttctctggttttagtattctgtaatatccactcaaccccatctaccagtggtttatgtcaattagtatgttttcaaaaatctcttggatttcctaatcaacatgttcattagaggtattgtttagaagtcactgatcaaattctgagaacaaaaggcgcctgggatgctgattaggattacattatatggatatatatgatgaggtaggattgccacttttatggggttattgggaaatgtttacctttcaagttctgatttccatgagtgggattttccctatacccattcctagcttctctgccacattatgcattctgccccaggcatgaggaagtgggcttatctagttggtaagatagtgatgggtaactgggtttgctcagctgaactccctcttcattgtgggctgacctgcaagtataatttcttgtcacagatattgcctgtgattggtaaattggtctaattctgtcattcagctaattggcccattagctgaatggtcacactaagttgcatcctccaactcaatttgatcagtaataaaagtttcatcctgccccctgtctgctacttaattttttatcgtttagatggggggaaattgtgctatttatttggggcccttcagagaacccaatatgaacatgatttatctatttattcagtttttatgtccttcaggacagataaatgtatgtatacacacatatacatgtgttaatatatgtaagtatatacatatgtttaaatgtatgtgtatgtgtatactgatcttgctcttttcctgtgaaatgtattaatagtcacttcaaagatttggttgctattgtgaaagaaattaagttacctttcactttgaaactaatagagtaaagaaaaacaaaaatacct

SEQ ID NO: 202187 - DNA, 3487 bp, Homo sapiens
  Payload ID: 19882
  Gene Name: zinc finger protein 334
  ENST ID: ENST00000457685
  CDS Start-End: 1325-3253
aggctcttccgggtgagggtcctgcagcccgtgaatccctggtcccgccgagacttggacctggtgcgaactggaggcgaagcgggtgcacccacaacctataggaagggctggcggcgagctctgagcactcgggcgtcggagggaacggtggggccgggcggagcgggcctcgggtctgcggagggtggacgcgcgctctccctgtctttggagggagggtttcctgtggtcgggaggcgaggcagccagggcaggattgggctcctgacctgcaggccacgggcgagctctctctagggccctgatttgcccgaagaaggcgcttggtgaaggtgaaaggtttacgcatccaagtagctagaacctctttccagaacttctgctgatgcacttagtcttgcagccattgattattatagctcagcaaagttcagttcaactttcggaagaaggatgtgagctggaatgggcagggtcaagatttgacaggaaaagacacttcactggaggtatctgcgagagtcctgggttggagggaaggagtactggttataaataaggaaatgatgtcttcatcacttcctaaacacatacatgtcattccctaccatctccaccctctgtttattcagagctgcaccaaccatgttcatcacctcacctgggatttactgagtttaccccttacagagctacacgataggggtaaaggaaagactaaaaaccaatttatcttatattaaaattacgacttagtaaatatttttttcagtaatgcagtttgctagtgacagatccaataactgaattctggtcctttgagtaccaggtcagggcttttgtcatctaccacatttacgttacctaccacaagaagtttcttagtaaaaggtcctcttgtgaaactgcagctaagggaaaccaaactgtcaaaaagacaaacaccttaaagcactttcattcattctctctggattctgtcatctcaagtggctaaacacattagtaggaaaacagctctgctttcaacactcttggccctttctcaagagaacatgaaaatgaaaaaatttcagagatggggttttgccgtgttgcccagactgatcttgagcttctgagctccagcgatcagcctacctcaacctctcagagtgctgggattataggtgtgcgccaccacacctggccatgtgtgttttcttacatctcctttcttacataaaagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtgaactatgaaaatattcaacagcaattcaaa

SEQ ID NO: 202188 - DNA, 2243 bp, Homo sapiens
  Payload ID: 19882
  Gene Name: zinc finger protein 334
  ENST ID: ENST00000596323
  CDS Start-End: 1724-2243
tataggtgtgcgccaccacacctggccatgtgtgttttcttacatctcctttcttacataaaaggtaatatattatagatattctttaatactttgcttttttcacttcatatcagttcatggagaccttcctcattatttatgctttcaaatattgcttctgatcactgtggtatctctcctgtgagctccagaaccatatatcaaactgccagctagatatctgtacttctttactcaacagacacttcaagcacagcatggtaaagatcagtgccttcatttcctatgctcgattctcttttttgttttgttttcctaatctccacatatactactagcgtcagcccagctgatcatgtgaaataatatgcacattacatctactgcacatcaagtagtggtcaactctccttgcctcccgttatgtaggactgattctctccttcccatttcccaggaactacctgtgctcatgtcctgtagtagtgtcttagttttcttcccttctaatttgacctttaagccagtttccatttttctagagtaggggacagcaaatgttttctttagaggacaaggtcaaaatttttggctttgctggccctgtggtctctgttggatttccttggcacagctgttgtgacatgaaagcagtcatagactgtgtgtaacaaatgagcgtgaccacgtttggctcccagtggcctagattttgcccacggactgaagtttgccaactcttatgctctagagcattgtttcaaaatacacatttggtcacaaatctccagtccttgcttacaaataactctttatggatttccattatttataacagtgatctccaaagtggaggatagggagcaccccagcaattcactggacttctattcttgtatttcagccaaaagaatgaaaaaataattaagctttattgatattagtgtatagctggaactcacttggaaatatactacaattcctaagtaaatgtacgttagcgtatatgcaagaatgttttactgatgtgccgtactatctaaatttcaagactactaattagagaaaagagttcctctattctctgacctctgtcccgctcctcactaacctttcctgtggagagattgtagttctcgaactccccatatgtgttttgtgtctgtgtatattcttaatggctacagtcctataaaacatactgtttatatttcaggactaaaattattatgctctcaaggaaggggtaacaaaaatggagcaagctttcttcttttgtgatcacccttcatcttgtgtatatgtccagcattgctctttaaagatgtacatttctatttttgtcaccctgtcagaatgtatgctcctaaagagtaagattagtattttatgtgattagtaatccaggcaattggaatagctccaggacatggtataagctcagcacatttttaaaattcattttaaaaaatgaacacagtgacagatttttaattttctgccctcccacaattacatctctctatagctttccattagccatggcagtggtcttcttatagtttatgttaccatacatttgatatcactcaattttggtcacccaagattaaacattttctttcagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactata

SEQ ID NO: 202189 - DNA, 2635 bp, Homo sapiens
  Payload ID: 19882
  Gene Name: zinc finger protein 334
  ENST ID: ENST00000593880
  CDS Start-End: 296-2407
gtgggtttttttgtttttttgagatgaggtcttgcactgtcacccaggctgctggagtacagtggcacaatctgagctcactgcaacctctgactcccagactcaagtgatcctcttgcctcagccacccgagtagcacatgccaccatgcctggctaatttttttttatttttttgtagagatggggttttgccgtgttgcccagactgatcttgagcttctgagctccagcgatcagcctacctcaacctctcagagtgctgggattataggtgtgcgccaccacacctggccatgtgtgttttcttacatctcctttcttacataaaagataccagtttcattccaggacctgactgtgaacttcacccaagaggaatggcagcaactggaccctgctcagaggctcctgtacagggatgtgatgctggagaactacagcaacttggtctctgtggagtctctgatgtccaaagatcttggtccaagttctgtaatttcccattaacagggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtgaactatgaaaatattcaacagcaa

SEQ ID NO: 202190 - DNA, 3706 bp, Homo sapiens
  Payload ID: 19882
  Gene Name: zinc finger protein 334
  ENST ID: ENST00000615481
  CDS Start-End: 1-2040
atggaaaatgagaaggagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtgaactatgaaaatattcaacagcaattcaaaggttatgccaaatgtgcctcccttttaaaataatgaaacaaacattgtttaagttaaattgttacttggttcctccccacagtgttacttgatagtgtatgttacgaggtgtgaggatctgaccttcatttcaaatcaataccattgtttgatagttgagtaagttacagtttctcaatttatggtgtattttcagatttggcagattttttgttgtctgctaactccatagtcttctagtagtggactgtatacctttatctgcaaaggtgacaactcaggagaactaaccattgtactctatgcacccatggtaattataccccaggtgagcattttgtaaagctgagccagtgaaagcccttcctaagacctttctaatggaagataggcacaggataactagttcatgatcctgaagctttcagctaagtcaagaagacggcaattgcagtaggaaaaacatgggaaaataagcattcttgaacaacaaagagaatttggatgatggttgaatccaaaaagtgtttatttctctggttttagtattctgtaatatccactcaaccccatctaccagtggtttatgtcaattagtatgttttcaaaaatctcttggatttcctaatcaacatgttcattagaggtattgtttagaagtcactgatcaaattctgagaacaaaaggcgcctgggatgctgattaggattacattatatggatatatatgatgaggtaggattgccacttttatggggttattgggaaatgtttacctttcaagttctgatttccatgagtgggattttccctatacccattcctagcttctctgccacattatgcattctgccccaggcatgaggaagtgggcttatctagttggtaagatagtgatgggtaactgggtttgctcagctgaactccctcttcattgtgggctgacctgcaagtataatttcttgtcacagatattgcctgtgattggtaaattggtctaattctgtcattcagctaattggcccattagctgaatggtcacactaagttgcatcctccaactcaatttgatcagtaataaaagtttcatcctgccccctgtctgctacttaattttttatcgtttagatggggggaaattgtgctatttatttggggcccttcagagaacccaatatgaacatgatttatctatttattcagtttttatgtccttcaggacagataaatgtatgtatacacacatatacatgtgttaatatatgtaagtatatacatatgtttaaatgtatgtgtatgtgtatactgatcttgctcttttcctgtgaaatgtattaatagtcacttcaaagatttggttgctattgtgaaagaaattaagttacctttcactttgaaactaatagagtaaagaaaaacaaaaatacctaa

SEQ ID NO: 202191 - DNA, 2495 bp, Homo sapiens
  Payload ID: 19882
  Gene Name: zinc finger protein 334
  ENST ID: ENST00000625284
  CDS Start-End: 248-2287
tcttccgggtgagggtcctgcagcccgtgaatccctggtcccgccgagacttggacctgctctgctttcaacactcttggccctttctcaagagaacatgaaaatgaaaaaatttcagacttggatgaaaccacacaccatgaggtgtggtaccagcttcctgaggggccagatggtggagccagatgatgcaacctggaagtgtgcgcaagttaactcaccgtgggtgaaccttgaatgaagggaaatggaaaatgagaaggagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtgaact

SEQ ID NO: 202192 - DNA, 4430 bp, Homo sapiens
  Payload ID: 19883
  Gene Name: zinc finger protein 335
  Uniprot ID: Q9H4Z2
  ENST ID: ENST00000322927
  CDS Start-End: 102-4130
cgacctcgtcgatgccggagtcagagaggaacgtggctacgaaagcctcggagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgtggggcaaagctcggaccgcggcagccgttctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctgggctcggccatcgacaagatcatcgagtccaccatcgggcccgacctcatccagaactgcatcactgtgaccagtgctgaggatggcggggccgagaccacacggtacctgatcctacagggcccagatgatggagcccccatgacatcaccaatgtccagttccaccttggcccacagcctagcagccattgaggccctggcagatggccccacatccacatccacatgcctggaggcacagggtgggcccagctccccggtgcagctgcccccagcctccggtgccgaagagccggacctgcagagcctggaggccatgatggaggtggtggtggtgcagcagttcaaatgcaagatgtgccagtaccggagcagcaccaaggccacactgctgcgccacatgcgggaacgccacttccgtccagtagcagcagccgcagcagcagctggtaaaaaaggacgtctacggaagtggagcacctccaccaagagccaagaggaagagggaccagaggaggaggacgatgatgacattgtagacgctggagccattgatgacctggaggaggatagcgactataatccagctgaggatgagccccgaggccggcagcttcggctccagcgccccacccccagtaccccaaggccccgaaggagacctggccggccccggaagctgccccgcctggagatctcagacctcccagatggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggaagaagaggccagatccgactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtgagtactgccacttcagcacacggcacaagaagaacctgcgcctgcacgtacggtgccgacacgcaagcagcttcgaggaatgggggaggcgccaccctgaggagcccccctcccgccgtcgccccttcttctctctgcagcagattgaggagctgaagcagcagcacagtgcggcccctggaccacctcccagttccccaggacctcctgagatacccccagaggcgacaactttccagtcatctgaggctccctcattgctctgttctgacaccctgggcggcgccaccatcatctaccagcaaggagctgaggagtcgacagcgatggccacgcagacagccttggatcttctgctgaacatgagtgctcagcgggaactggggggcacagccctgcaggtggctgtggtgaagtcggaagatgtggaagcagggttagcatcccctggtgggcagccctcccctgaaggtgccactccacaggtggtcaccctccacgtggcagagccagggggcggtgcagcagccgagagccagctaggccctcctgacctaccgcagatcaccctggcacctggtccatttggtgggactggctacagtgtcatcacagcaccccctatggaggagggaacatcagctcctggcacaccttacagcgaggagcccgcaggagaggcagcccaggctgtggttgtgagtgacaccctaaaagaagctggcacccactacatcatggctactgatggtacccagttgcaccacattgagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacactgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagctta

SEQ ID NO: 202193 - DNA, 3205 bp, Homo sapiens
  Payload ID: 19884
  Gene Name: zinc finger protein 337
  Uniprot ID: Q9Y3M9
  ENST ID: ENST00000252979
  CDS Start-End: 133-2388
agatccctgggcgtcagcgagccgtgagatgcgtggtccaccatcggtgacctcaccgcctcggttcgccctcagccgccccgattggccatctgcaagcttcccttctccgtggagagcaggaagacagtcatgggacctcagggagccaggagacaggctttcttggcatttggggatgtcactgtggatttcacccagaaggaatggaggctgctgagccctgctcagagggccctgtacagggaggtgacactggagaactacagccacctggtctcactaggaattctccattctaaaccagaactcatcaggcggctagagcaaggggaagtgccctggggagaagagagaagacgccggccaggcccctgtgcaggaatatatgcagaacatgtcctgcggcccaagaatcttggacttgcacatcagaggcaacagcaactacaattttctgatcaaagcttccagagtgacacagctgaaggtcaagagaaagaaaaaagcactaagcccatggcattttccagcccacccctaagacatgcagtaagctcaaggaggaggaacagtgtagtggaaatagagtctagtcaaggccagagggaaaatcctacagaaatagacaaagtattgaaaggaatagaaaattcaagatggggagcattcaagtgtgcagagcgtgggcaagacttcagccggaagatgatggtaatcatacacaaaaaagcacattccaggcagaaactttttacatgcagggagtgtcaccagggctttagagatgagtcagcattgctcttgcaccagaacacacacacaggagagaagtcctatgtgtgcagtgtgtgtgggcgaggcttcagcctcaaggccaacctcctcagacaccagaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcactttacaccagaggacacactcagaggagaagccttatggatgtcgggagtgtgggcgaaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtgagaaaagttttagtttgaaggcaaatcttcttagacatcagtggacacactcgggggaaaggccatttaattgcaaggattgcgggcgaggcttcatcctaaaatcaactctcctcttccaccagaagacacactcaggggagaagcctttcatctgtagtgaatgtgggcaaggatttatctggaagtcaaatcttgtgaaacaccagcttgcacattctggcaagcagccttttgtatgcaaggagtgtgggcgaggcttcaactggaagggaaatctcctcacacaccagaggacacactcaggggagaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatcagaggacacactcaggagagtaactttgctttgttacaagctttagttgaggctgcataacttgttcgtgaagatataacagaggcagacagaatccagagggctacagagaacctgaattcaacccatgtgtccccaagagattcagagaaaagaggtcaatgtttagggaacagagatgccagttgaggggagggcattacctgggctattggggaaatgtggtctctttcctactgagcacatattcttgttgtatttgtgccaggctgtgctttctaaggactgctcttagccagtgactgcagagcagggataccaaggcaggcctgttacactctccccaacctccttggactgcaaacaatctaggacacctccaccaaacctcctcttgcactttccctctggcttccctcccagccttccttggtttggatgttttgtcccctccttaatttatgttgaaactctacataaactgtttactgttgaaacagtgtaagtattaggaggtgggacctttgggaagtgattaagtcaagtcacgaagatagagctttgcgaatgggatcaggtgcccttatgaaaaggcttgatagagggagtttgtcctgtggcccttctattttctgctctgtgaggacacaatgctcctcccttccaaaagatgcagcatgaaggcatcatcttggaaacagacatgagccctcaacagacaactgcacctactgatgttttgatgttgaacttcccagcctccagaactctgggaaaataaagtcctctttataca

SEQ ID NO: 202194 - DNA, 3613 bp, Homo sapiens
  Payload ID: 19884
  Gene Name: zinc finger protein 337
  Uniprot ID: Q9Y3M9
  ENST ID: ENST00000376436
  CDS Start-End: 541-2796
cacactccccatgctattaatttgttaaaggctttggtgttgtacagtactgaataactgccaatgccatctgcctgtggccttctcaagtttgtctgcacctgtggttatcctgacttcaaacccggggagacagaggctagaagaggcagacagctcttgtgtattctgtccagtgcaaagaacacctggaactctgagccctaaccttaaatgcaagacctcatctgcaggtgttcctcatccttttagcccctcagtgatgtaagcaacaaacgtcacccagctcctggggcacacttcactcccagatgagcttgtcctggatttgcagggagcctggctccctagaccttttggccagatccccacaggggaattgtgcaggtgcgccctccccagatccccagttggtattggaatcacaccaactgtcacacatggggagggcagctgcacccagccaccctctgacttctctcctcccacagattggccatctgcaagcttcccttctccgtggagagcaggaagacagtcatgggacctcagggagccaggagacaggctttcttggcatttggggatgtcactgtggatttcacccagaaggaatggaggctgctgagccctgctcagagggccctgtacagggaggtgacactggagaactacagccacctggtctcactaggaattctccattctaaaccagaactcatcaggcggctagagcaaggggaagtgccctggggagaagagagaagacgccggccaggcccctgtgcaggaatatatgcagaacatgtcctgcggcccaagaatcttggacttgcacatcagaggcaacagcaactacaattttctgatcaaagcttccagagtgacacagctgaaggtcaagagaaagaaaaaagcactaagcccatggcattttccagcccacccctaagacatgcagtaagctcaaggaggaggaacagtgtagtggaaatagagtctagtcaaggccagagggaaaatcctacagaaatagacaaagtattgaaaggaatagaaaattcaagatggggagcattcaagtgtgcagagcgtgggcaagacttcagccggaagatgatggtaatcatacacaaaaaagcacattccaggcagaaactttttacatgcagggagtgtcaccagggctttagagatgagtcagcattgctcttgcaccagaacacacacacaggagagaagtcctatgtgtgcagtgtgtgtgggcgaggcttcagcctcaaggccaacctcctcagacaccagaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcactttacaccagaggacacactcagaggagaagccttatggatgtcgggagtgtgggcgaaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtgagaaaagttttagtttgaaggcaaatcttcttagacatcagtggacacactcgggggaaaggccatttaattgcaaggattgcgggcgaggcttcatcctaaaatcaactctcctcttccaccagaagacacactcaggggagaagcctttcatctgtagtgaatgtgggcaaggatttatctggaagtcaaatcttgtgaaacaccagcttgcacattctggcaagcagccttttgtatgcaaggagtgtgggcgaggcttcaactggaagggaaatctcctcacacaccagaggacacactcaggggagaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatcagaggacacactcaggagagtaactttgctttgttacaagctttagttgaggctgcataacttgttcgtgaagatataacagaggcagacagaatccagagggctacagagaacctgaattcaacccatgtgtccccaagagattcagagaaaagaggtcaatgtttagggaacagagatgccagttgaggggagggcattacctgggctattggggaaatgtggtctctttcctactgagcacatattcttgttgtatttgtgccaggctgtgctttctaaggactgctcttagccagtgactgcagagcagggataccaaggcaggcctgttacactctccccaacctccttggactgcaaacaatctaggacacctccaccaaacctcctcttgcactttccctctggcttccctcccagccttccttggtttggatgttttgtcccctccttaatttatgttgaaactctacataaactgtttactgttgaaacagtgtaagtattaggaggtgggacctttgggaagtgattaagtcaagtcacgaagatagagctttgcgaatgggatcaggtgcccttatgaaaaggcttgatagagggagtttgtcctgtggcccttctattttctgctctgtgaggacacaatgctcctcccttccaaaagatgcagcatgaaggcatcatcttggaaacagacatgagccctcaacagacaactgcacctactgatgttttgatgttgaacttcccagcctccagaactctgggaaaataaagtcctctttataca

SEQ ID NO: 202195 - DNA, 6196 bp, Homo sapiens
  Payload ID: 19885
  Gene Name: zinc finger protein 33A
  ENST ID: ENST00000307441
  CDS Start-End: 204-2693
tgcctcgtccgccggctacgtctgcgtttccgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaagcagtgatccctaaaagatgtgccctagaggatatccagaacaatccaattggatgtcttctccgctgtactccacagaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatagtttttagggcacctaacaataatttatagatgtatattgtggaatgtaaagctttaagaacttaaacaaaggtaataattaaaataacctcacaagaagtttaatgagtagagagaattcccatgtacacttcaccaaacttcctctaaggataatgtataatcatagtatatggtcaagtccaagaaatcgatgttaccttgctggtagatagagacttagtcagattttactatggtttgcatgcactctgtgtgtgtgtgtacgtgtatgtgtgtgtgtgtggttatatcaaacttttacgacttttacatttgagtaaccatcaacacgattagtttacagaactgaaaaggaatctgagatctgtactgtatcaggattacaaaggatttagcctcaagtagttccctttttgtattaataaccacacgctttctgcaaccctatcccttgcatccacttgactatgaagtttttttaaagcacagataaattgaataatcagggcaatagcattaagcacatctgcgaattatccctgaagttcaaaagacttatatatgtataagtggtatgtgatataaatcgtgtgtttcatatgcataatggaatttaacgtaattgtgaataggaagtaggtatcctagtttagtagtggttacattatcaggcccatcccagatgtttgtgatgtcctgaaacaatttaaaaggagacccacagagctaatgtttatccatttaaaaggtataaatcaaaataacaaattatctaaaaaaaatctatcctgtacatgtgaagatctaggctcgcctccatgttactccctttctcttcctacctgtggctcatgccatgccatgaagtgcctagggtacatatgtgaacattccagccttcagcataagtggtagtccaaattttctttaagcagctgctctccaagacagggccctggaaaggcccacacatacagcccagggctgcccagggctgttggactgtcatttcaaggctcattgtccccagacagggatctgggccctcagacttttgagaatatgaagaggagggttgaggctggagcagaaccagaatcaagctggtgtggggcttttattgatagtgtgaagattgtacactatattacatgatcagatcatacaaataatctaagattatacagtctagtgatcctagattacacaagtaatctaagcttccactttaggaaactagaaaaagaagagcaaattaaatccaaagtaacctgaaaaaacattagagtaaaaatcattgaaattgaaaagagaaaatcgataaaacccaaaactggttccttgaaaaggtcagtaaaattgataaacctctagctagcttaagaacaaacagaagacaaatattgctaataccaaaaatgaaagaggccatcacagctaatcctatggtcaccaaaaggattagaaagaaacatggacaactctgtccataaatttgataacttagctaaaatggaccaattccttgcaagacgcattctctcaaagctcacacaagatagacctcaataggcatatgtatctattaaataaaccaaagcagtaattaataaccttccaaggccaggtacagtggttcatgcctgtaatcccagcacttcactttgggaggctgaggcgggtggatcacaaggtcaggagttcgagaccagcctggtcaacatggtgaaaccccctatctactaaaaatacaaaaaattagctgggcatggtggcatgcgtgtgtagtcgaagctactcaggaggctgaggcagaagaatcacttgaacctgggaggtggatgttgcagtgagctgagattgtgccactgtactgcagcctgggtgacagaatgagactgcatctcaaaaaataataatgaaactttccaaaacaaagtgccaggaccagctgggttcactgatgtgtttttgagatacttaaggtagaaatgataccaagtctctaccatctctttcagaaaataaaagcagagataacacttcccaactcattttgtgaggccagtattaccctaatagcaaaaccaggcaaagatattacaagaaaggaaaactacagatcaatatttccattgaacacagatgcagaaatcctcaaaatattagcaaatcaggaatgcaaggcttgttcaacatttgatattcagtgtaatccattgcatgcattagcagctcaaagatgaaatacgatcatatcaataggtacagaaaaagcatttgacaaaatccaatatccattcatgttaaaacctctcaacacagaaggaatacaggagaacttactcaagttggtaaagaacatactacaaaaaaccctacagctaacattatccttgatgtttccaactagacactttcctactaagatcaggaacatggcaaggaacaccacaccactgcttttcagcattgtactggaagtgctatataatgcagtgttaaaaaaaaaagaaataaaatgcacatagatttgaaaggatgaaatacaactttgttcacaagtaacatgattgtctttgtagagaattctaaataacaaaaaccctgctgacattaataagcaattacagcaggattgcaggatacagtcctcaggtagatgataaaaaggaattggacatcaagtcattaaaagacacggagaaaccctaaatgcttattgttaagtgaaaaccaatctgaaaaggctttctattttgtatgattgcaattatatgacattttgggagaggcaaaactattgagccagtgaaaggaccagtggttgctgagagttgaggggaaaggagggatggcaggtagagaggtgatttttaaggcagtgaaagtactctctagggtactgtaatttgtcaaaacgcagagaatggaaaacagtgaacggaaaacacagagtaaaccctaatgtcaactctggacttcagttaataataatgtatcactgttggctcattaattgtaacaaatgaaccataatgatgcaagatgttaatgattggggagcctgtggaagatgggaggggaaagggttatatgagaattctctatactttttgctcaactttctgtaaccctaaagctactctaaaaaatgaagtgtatcaagtaaataaataaccaaccaaccaaccctgagg

SEQ ID NO: 202196 - DNA, 6122 bp, Homo sapiens
  Payload ID: 19885
  Gene Name: zinc finger protein 33A
  ENST ID: ENST00000374618
  CDS Start-End: 520-2619
tgcctcgtccgccggctacgtctgcgtttccgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtgggtaagggtattgtgttcacaaaccagaggtgatcttcaggctgcaacaaggagaagagccatggaaacaggaggaagaattcccaagccaaagctttccagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatagtttttagggcacctaacaataatttatagatgtatattgtggaatgtaaagctttaagaacttaaacaaaggtaataattaaaataacctcacaagaagtttaatgagtagagagaattcccatgtacacttcaccaaacttcctctaaggataatgtataatcatagtatatggtcaagtccaagaaatcgatgttaccttgctggtagatagagacttagtcagattttactatggtttgcatgcactctgtgtgtgtgtgtacgtgtatgtgtgtgtgtgtggttatatcaaacttttacgacttttacatttgagtaaccatcaacacgattagtttacagaactgaaaaggaatctgagatctgtactgtatcaggattacaaaggatttagcctcaagtagttccctttttgtattaataaccacacgctttctgcaaccctatcccttgcatccacttgactatgaagtttttttaaagcacagataaattgaataatcagggcaatagcattaagcacatctgcgaattatccctgaagttcaaaagacttatatatgtataagtggtatgtgatataaatcgtgtgtttcatatgcataatggaatttaacgtaattgtgaataggaagtaggtatcctagtttagtagtggttacattatcaggcccatcccagatgtttgtgatgtcctgaaacaatttaaaaggagacccacagagctaatgtttatccatttaaaaggtataaatcaaaataacaaattatctaaaaaaaatctatcctgtacatgtgaagatctaggctcgcctccatgttactccctttctcttcctacctgtggctcatgccatgccatgaagtgcctagggtacatatgtgaacattccagccttcagcataagtggtagtccaaattttctttaagcagctgctctccaagacagggccctggaaaggcccacacatacagcccagggctgcccagggctgttggactgtcatttcaaggctcattgtccccagacagggatctgggccctcagacttttgagaatatgaagaggagggttgaggctggagcagaaccagaatcaagctggtgtggggcttttattgatagtgtgaagattgtacactatattacatgatcagatcatacaaataatctaagattatacagtctagtgatcctagattacacaagtaatctaagcttccactttaggaaactagaaaaagaagagcaaattaaatccaaagtaacctgaaaaaacattagagtaaaaatcattgaaattgaaaagagaaaatcgataaaacccaaaactggttccttgaaaaggtcagtaaaattgataaacctctagctagcttaagaacaaacagaagacaaatattgctaataccaaaaatgaaagaggccatcacagctaatcctatggtcaccaaaaggattagaaagaaacatggacaactctgtccataaatttgataacttagctaaaatggaccaattccttgcaagacgcattctctcaaagctcacacaagatagacctcaataggcatatgtatctattaaataaaccaaagcagtaattaataaccttccaaggccaggtacagtggttcatgcctgtaatcccagcacttcactttgggaggctgaggcgggtggatcacaaggtcaggagttcgagaccagcctggtcaacatggtgaaaccccctatctactaaaaatacaaaaaattagctgggcatggtggcatgcgtgtgtagtcgaagctactcaggaggctgaggcagaagaatcacttgaacctgggaggtggatgttgcagtgagctgagattgtgccactgtactgcagcctgggtgacagaatgagactgcatctcaaaaaataataatgaaactttccaaaacaaagtgccaggaccagctgggttcactgatgtgtttttgagatacttaaggtagaaatgataccaagtctctaccatctctttcagaaaataaaagcagagataacacttcccaactcattttgtgaggccagtattaccctaatagcaaaaccaggcaaagatattacaagaaaggaaaactacagatcaatatttccattgaacacagatgcagaaatcctcaaaatattagcaaatcaggaatgcaaggcttgttcaacatttgatattcagtgtaatccattgcatgcattagcagctcaaagatgaaatacgatcatatcaataggtacagaaaaagcatttgacaaaatccaatatccattcatgttaaaacctctcaacacagaaggaatacaggagaacttactcaagttggtaaagaacatactacaaaaaaccctacagctaacattatccttgatgtttccaactagacactttcctactaagatcaggaacatggcaaggaacaccacaccactgcttttcagcattgtactggaagtgctatataatgcagtgttaaaaaaaaaagaaataaaatgcacatagatttgaaaggatgaaatacaactttgttcacaagtaacatgattgtctttgtagagaattctaaataacaaaaaccctgctgacattaataagcaattacagcaggattgcaggatacagtcctcaggtagatgataaaaaggaattggacatcaagtcattaaaagacacggagaaaccctaaatgcttattgttaagtgaaaaccaatctgaaaaggctttctattttgtatgattgcaattatatgacattttgggagaggcaaaactattgagccagtgaaaggaccagtggttgctgagagttgaggggaaaggagggatggcaggtagagaggtgatttttaaggcagtgaaagtactctctagggtactgtaatttgtcaaaacgcagagaatggaaaacagtgaacggaaaacacagagtaaaccctaatgtcaactctggacttcagttaataataatgtatcactgttggctcattaattgtaacaaatgaaccataatgatgcaagatgttaatgattggggagcctgtggaagatgggaggggaaagggttatatgagaattctctatactttttgctcaactttctgtaaccctaaagctactctaaaaaatgaagtgtatcaagtaaataaataaccaaccaaccaaccctgagg

SEQ ID NO: 202197 - DNA, 6084 bp, Homo sapiens
  Payload ID: 19885
  Gene Name: zinc finger protein 33A
  Uniprot ID: Q06730
  ENST ID: ENST00000458705
  CDS Start-End: 159-2591
tctgcgtttccgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatagtttttagggcacctaacaataatttatagatgtatattgtggaatgtaaagctttaagaacttaaacaaaggtaataattaaaataacctcacaagaagtttaatgagtagagagaattcccatgtacacttcaccaaacttcctctaaggataatgtataatcatagtatatggtcaagtccaagaaatcgatgttaccttgctggtagatagagacttagtcagattttactatggtttgcatgcactctgtgtgtgtgtgtacgtgtatgtgtgtgtgtgtggttatatcaaacttttacgacttttacatttgagtaaccatcaacacgattagtttacagaactgaaaaggaatctgagatctgtactgtatcaggattacaaaggatttagcctcaagtagttccctttttgtattaataaccacacgctttctgcaaccctatcccttgcatccacttgactatgaagtttttttaaagcacagataaattgaataatcagggcaatagcattaagcacatctgcgaattatccctgaagttcaaaagacttatatatgtataagtggtatgtgatataaatcgtgtgtttcatatgcataatggaatttaacgtaattgtgaataggaagtaggtatcctagtttagtagtggttacattatcaggcccatcccagatgtttgtgatgtcctgaaacaatttaaaaggagacccacagagctaatgtttatccatttaaaaggtataaatcaaaataacaaattatctaaaaaaaatctatcctgtacatgtgaagatctaggctcgcctccatgttactccctttctcttcctacctgtggctcatgccatgccatgaagtgcctagggtacatatgtgaacattccagccttcagcataagtggtagtccaaattttctttaagcagctgctctccaagacagggccctggaaaggcccacacatacagcccagggctgcccagggctgttggactgtcatttcaaggctcattgtccccagacagggatctgggccctcagacttttgagaatatgaagaggagggttgaggctggagcagaaccagaatcaagctggtgtggggcttttattgatagtgtgaagattgtacactatattacatgatcagatcatacaaataatctaagattatacagtctagtgatcctagattacacaagtaatctaagcttccactttaggaaactagaaaaagaagagcaaattaaatccaaagtaacctgaaaaaacattagagtaaaaatcattgaaattgaaaagagaaaatcgataaaacccaaaactggttccttgaaaaggtcagtaaaattgataaacctctagctagcttaagaacaaacagaagacaaatattgctaataccaaaaatgaaagaggccatcacagctaatcctatggtcaccaaaaggattagaaagaaacatggacaactctgtccataaatttgataacttagctaaaatggaccaattccttgcaagacgcattctctcaaagctcacacaagatagacctcaataggcatatgtatctattaaataaaccaaagcagtaattaataaccttccaaggccaggtacagtggttcatgcctgtaatcccagcacttcactttgggaggctgaggcgggtggatcacaaggtcaggagttcgagaccagcctggtcaacatggtgaaaccccctatctactaaaaatacaaaaaattagctgggcatggtggcatgcgtgtgtagtcgaagctactcaggaggctgaggcagaagaatcacttgaacctgggaggtggatgttgcagtgagctgagattgtgccactgtactgcagcctgggtgacagaatgagactgcatctcaaaaaataataatgaaactttccaaaacaaagtgccaggaccagctgggttcactgatgtgtttttgagatacttaaggtagaaatgataccaagtctctaccatctctttcagaaaataaaagcagagataacacttcccaactcattttgtgaggccagtattaccctaatagcaaaaccaggcaaagatattacaagaaaggaaaactacagatcaatatttccattgaacacagatgcagaaatcctcaaaatattagcaaatcaggaatgcaaggcttgttcaacatttgatattcagtgtaatccattgcatgcattagcagctcaaagatgaaatacgatcatatcaataggtacagaaaaagcatttgacaaaatccaatatccattcatgttaaaacctctcaacacagaaggaatacaggagaacttactcaagttggtaaagaacatactacaaaaaaccctacagctaacattatccttgatgtttccaactagacactttcctactaagatcaggaacatggcaaggaacaccacaccactgcttttcagcattgtactggaagtgctatataatgcagtgttaaaaaaaaaagaaataaaatgcacatagatttgaaaggatgaaatacaactttgttcacaagtaacatgattgtctttgtagagaattctaaataacaaaaaccctgctgacattaataagcaattacagcaggattgcaggatacagtcctcaggtagatgataaaaaggaattggacatcaagtcattaaaagacacggagaaaccctaaatgcttattgttaagtgaaaaccaatctgaaaaggctttctattttgtatgattgcaattatatgacattttgggagaggcaaaactattgagccagtgaaaggaccagtggttgctgagagttgaggggaaaggagggatggcaggtagagaggtgatttttaaggcagtgaaagtactctctagggtactgtaatttgtcaaaacgcagagaatggaaaacagtgaacggaaaacacagagtaaaccctaatgtcaactctggacttcagttaataataatgtatcactgttggctcattaattgtaacaaatgaaccataatgatgcaagatgttaatgattggggagcctgtggaagatgggaggggaaagggttatatgagaattctctatactttttgctcaactttctgtaaccctaaagctactctaaaaaatgaagtgtatcaagtaaataaataaccaaccaacc

SEQ ID NO: 202198 - DNA, 3994 bp, Homo sapiens
  Payload ID: 19885
  Gene Name: zinc finger protein 33A
  Uniprot ID: Q06730
  ENST ID: ENST00000432900
  CDS Start-End: 160-2595
gtctgcgtttccgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatagtttttagggcacctaacaataatttatagatgtatattgtggaatgtaaagctttaagaacttaaacaaaggtaataattaaaataacctcacaagaagtttaatgagtagagagaattcccatgtacacttcaccaaacttcctctaaggataatgtataatcatagtatatggtcaagtccaagaaatcgatgttaccttgctggtagatagagacttagtcagattttactatggtttgcatgcactctgtgtgtgtgtgtacgtgtatgtgtgtgtgtgtggttatatcaaacttttacgacttttacatttgagtaaccatcaacacgattagtttacagaactgaaaaggaatctgagatctgtactgtatcaggattacaaaggatttagcctcaagtagttccctttttgtattaataaccacacgctttctgcaaccctatcccttgcatccacttgactatgaagtttttttaaagcacagataaattgaataatcagggcaatagcattaagcacatctgcgaattatccctgaagttcaaaagacttatatatgtataagtggtatgtgatataaatcgtgtgtttcatatgcataatggaatttaacgtaattgtgaataggaagtaggtatcctagtttagtagtggttacattatcaggcccatcccagatgtttgtgatgtcctgaaacaatttaaaaggagacccacagagctaatgtttatccatttaaaaggtataaatcaaaataacaaattatctaaaaaaaatctatcctgtacatgtgaagatctaggctcgcctccatgttactccctttctcttcctacctgtggctcatgccatgccatgaagtgcctagggtacatatgtgaacattccagccttcagcataagtggtagtccaaattttctttaagcagctgctctccaagacagggccctggaaaggcccacacatacagcccagggctgcccagggctgttggactgtcatttcaaggctcattgtccccagacagggatctgggccctcagacttttgagaatatgaagaggagggttgaggctggagcagaaccag

SEQ ID NO: 202199 - DNA, 1530 bp, Homo sapiens
  Payload ID: 19885
  Gene Name: zinc finger protein 33A
  ENST ID: ENST00000469037
  CDS Start-End: 143-559
tccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgcccctgagatgctcatgcccttggattaaacccctgcagtgctggaagaagaggactctgcactgcctgccacaccaggactggaagatccatggccttcccttcttccaaactaccttcccacaagatggggatggtggtcacatctccaacactagcatgctgtggaagagacatcagcattcttgcaacaaatctggaaacagcctaaagagacatttctacttcaaagagttgcactgaggaagtgcactggcactgctggggactcacctggggcccagggctgaggcttctcgtgtccttggagctgctgtcctcccgaggagtgtccacactgcagccagctcagcctcaggtgtcttctctggttttgaaaccaaatctaagtgggaaaagaagattcaagttttatccgatttagtctacataattttaagtatctatttgagctcaataccaagaatcacttccttctctctcccatctgtgatctccagaggaaaggtccccgggctaggagacactggctggcatcctaaagccagagctggccaaagggtgtgtgtccactcttccttcacctcttccccaccccacacttgtttttgtctcacgctcacttgctctttctgcctccctctcactctttaggtctcacaaaggctttggccaaagactgactgactttccttggctctctgtcatctccccatagtcaaaagcatttcataacacacaatccatgtgaagggacctctgatgaaaatccatttaaagaggagctcactaattatcaatacttactgctgagcctggaatcattcatatatacctcagagttcattcattccagatgcaatactagataaggagactcctatgaaccaaatatctaactctgaatagatagtgactgtcataatcaaaccctgtggctgcctcctccttactggagggtgtagaggaatgcagttttttgtttgtttatttgtttgtt

SEQ ID NO: 202200 - DNA, 2854 bp, Homo sapiens
  Payload ID: 19885
  Gene Name: zinc finger protein 33A
  Uniprot ID: Q06730
  ENST ID: ENST00000628825
  CDS Start-End: 100-2553
cgtccgccggctacgtctgcgtttccgcctttccttttgtttttctcaggttttgcgtgggaggcggtcccgggatttcaagggtctacgcgcttttctatggcgaatgcaacccgacgagggagtggggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatag

SEQ ID NO: 202201 - DNA, 5958 bp, Homo sapiens
  Payload ID: 19886
  Gene Name: zinc finger protein 33B
  Uniprot ID: Q06732
  ENST ID: ENST00000359467
  CDS Start-End: 116-2452
gggaggcggtcccgggatttcaggggtctaccggctctcttatggcgaatgcaacccgaagagagagtgagctgtatcttcagagttgtctccgtctttccaagaacagaacaaaatgaacaaggtagatcagaagttccaggggtcagtatcatttaaagatgtgactgtgggcttcacccaggaggagtggcagcacctggaccctagtcagagggctctgtatagagatgtgatgctggagaactacagcaaccttgtctcagtggggtattgtgctcacaaaccagaggtgatcttcaggctggaacaaggagaagaaccatggagactggaggaagaattcccaagccagagctttccagaagtctggacagctgatcacctgaaagagaggagccaagaaaatcaatctaaacatttgtgggaagttgtattcatcaataatgaaatgctgactaaggaacaaggtaatgtaataggaataccatttaacatggacgtaagttcttttccttccagaaaaatgttctgtcagtatgactcacgtggaatgagtttcaacactgtttcagaattggttatcagtaagataaactatttaggaaaaaagtctgacgaatttaatgcatgtgggaaattgttactcaatattaagcatgatgaaactcatactcgagagaaaaatgaagttttgaaaaataggaacactctgagtcatcgtgagaacactttgcagcatgagaagattcaaactttagaccacaattttgaatacagtatatgtcaggaaaccctccttgaaaaggcagtattcaatacacggaagagagagaatgcagaagagaataactgtgactataatgaatttgggagaactttctgtgatagttcatccctcttgttccatcagatacctccatcaaaggacagtcactatgaatttagtgattgtgagaagttcttatgtgtgaagtccaccctttctaaacatgatggggtacctgtgaaacactatgattgtggtgaaagtgggaataatttcaggaggaaattgtgtctgtcacagcttcagaaaggtgataaaggagagaaacactttgaatgtaatgaatgtgggaaagctttctgggagaagtcacatctcactcgacatcagagggtgcacacaggagagaaacactttcaatgtaatcaatgtggaaaaactttctgggagaagtcaaacctcactaaacatcagagatcacacacaggggagaaaccttttgaatgcaatgaatgtgggaaagcctttagccataagtcagccctcacattacaccagagaacacatacaggggagaaaccctatcagtgtaatgcatgtgggaaaactttttaccagaaatctgacctcactaaacatcagagaacacacacagggcagaaaccctatgaatgttatgaatgtggaaaatccttctgtatgaattcacaccttacagtacaccagagaactcacacaggtgagaaaccttttgaatgtcttgagtgtgggaaatccttttgtcaaaagtcacatcttacacagcatcagagaactcacataggagataaaccttatgaatgtaatgcatgtgggaaaactttctaccacaagtcagtactcaccaggcatcagataattcatacagggttgaaaccttatgaatgttatgaatgtgggaaaaccttctgcttgaagtcagacctcacaatacatcagagaacgcacacaggggagaaaccctttgcatgtcctgaatgtgggaaattctttagccataagtcaaccctctctcaacattatagaacacacacgggggagaaaccctatgaatgtcatgaatgtggaaaaatcttttacaataaatcatacctaacaaaacataatagaacacatacaggggagaaaccctatgaatgtaatgaatgtggaaaaaccttctgccagaagtcacaactcactcagcatcagagaattcacataggggagaaaccctatgaatgtaatgagtgtggaaaagctttctgccataagtcagctctaattgtacatcagagaacccatacacaagaaaagccttataaatgtaacgaatgtggaaaatctttctgtgtgaagtcaggacttattttacatgagagaaagcacacgggggagaaaccctatgaatgcaatgaatgtgggaaatccttcagtcacaaatcatcactcacagtacatcacagggctcacacaggagagaaatcttgtcagtgtaatgaatgtggaaaaatcttttaccgtaaatcagaccttgctaaacatcagagatcacatacaggggaaaagccctatgaatgtaacacatgcaggaaaaccttctctcaaaagtcaaatctcattgtacatcagagaacacacataggagaaaaaccttatgaatgaattggatattagaaatttccagccacaagtcagcctccataatgcctcagagtcttcacactgtggagaagggcctgttgacatcctgaatgttcaataactatccacaaactcgccttatgttactccaaagtaacagtaggggataaacccatagactacaacaactataggatggcttttgttaggaagtgatattctgttgaatatcagatggttaatactggcataaaacctcacagatttttttgaatttgtgaaagtttttggcaaaactacaaataggattatgttagcatttacactgaggagaaaattgtcaatttaagaaatctaaagtgaaaattttgcttagaaataaaatatgacaagttctgttttgagtttgatgccataatagtttttaaggtatctaacaataatttatagatgtacattgtggaatgtaaagctttaagaattttttaagaagtaataattaaaataacctcacaagaagttgtaatgagtacagagaattcccgtgtacccttcaccaagcttcctctaaggataatatataatcatagtatatggtcaagtccaagaaatcgatgttaccttgctagtagatgcagacttactcagattttgctatggtttgcgtgcactctgtgtgtgtacgtgtatgtgtgtgtgtgtggttataacaaactggtacttttacatttgagtaaccatcaacacaattagtttacagaatggaaaaggagtctgagatctgtactgtttcaggattacaaaggaatcaggatttagcctcaagtagttcccttgttgtattaataaccacaccctttctgcatccctgtccctggcatccacttgactatgaagctttttgtaaagcatagataaattgaataatcagggcaacagcattaagcacatctgtgaattatccctgaagttcataggacttacatatgtacaagtggtatgtgatataaatcgtgtgtttcatatgcataatggtatttaacgtaattgtgaataggaagtaggtatcctaatttagtagtggttacttcatcaggcccatcccaggtgtttgtcgtgtcctgaaacaatttaaatagagacccacagagctaatgtttatccatttaaaagttataaatcaaaataacagattatctgaaaaaaaatctatcctgtacgtgtgaagatctaggcctgcctccatgttactccctttctcttactacctgtggctcatcccatgccatgaactgcctggggtacatatgtgaacactccagccttcagcgtaagtgatagtccaaattttctttaagcagctgctctccaagacagggccctggaaagaggcccacacatacagcccagttgctgcccagggctgttggactgtcatttcattgctcattgtacccagacagggatctgggccttcagagacttttgagaatatgaagaggagggttgaggctggagaagagccagaatcaagctggcatggggcttttattgacagtgtgaagattgtacactacattacatgatcagatcatacaaataatctaagattttacagtctggtgaccctagattacacaagtaatctaagcttccactttggaaaactagaaaaagaagagcaaattaaatccaaagtaacctggaaaaaaattagagtaaaaatcagtgaaattgaaaagagaaaatcaataaaacccaaaactgttctttgaaaaggtgggtaaaattgataaacctctagctagattaagaaaaaacagaagacaaatactgctaataccaaaagtgaaagaggccatcatagctgatcctatggtcaccaaaaggattagaaagaaatatggacaactctgtccataaatttgataacttagctaaaatggatcaattccttgcaagatgcattctctcaaagctcataaaaggtagatctcagtaggcatatatatctattaaataaattgaagcagtaattaataaccttccaagaccaggcgcggtggctaaaaatacaaaaagttagccgggcgtggtggcatgcgtgtatagtccaagctactcaggaggctgaggcagaagaatcacttgaacctgggaggtggaggttgcagtgagccaagattgtgccactgtactccagcctgggtgacagagtgagactccatctcaataaaattaataataataaaaccttccaaaaaaagtgccgggaccaaatggattcactgatgtgcatttttcgagatacttaaggtagaaatgataccaagtctgtactgtctctttcagaaaataaaagcagggataacacttcccaaatcattttgtgaggccaggattaccctaataccaaagccaggcaaaaacattacaagaaaggaaaactacagatcaatatttccagtgaacacagatgcagaaatccttaaaatgttagcaaatcaggaatgcaagccttgttcaacatttgatattcagtgcaatccattgcatgcattagcagttcaaagattaaatatgatcatatcaataggtacagaaaaagcatttgacaaaatccaatatccattcatgataaaacctctcaacacagaaggaatacaggagaacttactcaatttgataaagaactactacaaaaaaccctacatctagcatcatccttgatgtttccaactaaatgctttcctactaagatcaggaacatggcaaggaacaccactgcttttcagcattgtactggaagtgctatctaatgcagtgataccaaaaaaaaaggaaataaaatgcacataaatttggaaggaggaaatacaactgtctttgttctcaaataacatgattgtctttgtagaaaattctaaataacaaaaacctgctgacattaataagcaattatagcagggttgtagaatgtagtcctcaggtatatgataaaaaagaattagacatcaagtcattaaaagacatataggaaccctaaatgcttattgttaagtgaaaaccaatctgaaaaggctttctatgttgtatgattgcaattatatgacattctgggagaggcaaaactatcgagcgagtcaaaggaccagtggttgctgagagttgaggggaaaggagggatggcaggtaggtgatttttaggacagtgaaagtactctgtagggtactgtaatttgtcaaaatgcagagaatggaaaacagtgaacggaaaacacagagtaaaccctagtgtcaactctggacttcagttaataacagtgtaccactattggctcatcaattgtaacaaatgaaccataatgatgcaagatgttaataattggggagcctgtggaggatgggagggttaaaggtttatatgagaattctctgtactttttgctcaatttttctgtaaccctaaagctgctctaaaaaatgaagtgtattaagtaaataaataagtaaataaccaaccaacc

SEQ ID NO: 202202 - DNA, 319 bp, Homo sapiens
  Payload ID: 19886
  Gene Name: zinc finger protein 33B
  ENST ID: ENST00000493285
  CDS Start-End: 49-319
tttgcgtgggaggcggtcccgggatttcaggggtctaccggctctcttatggcgaatgcaacccgaagagagagtgaggtagatcagaagttccaggggtcagtatcatttaaagatgtgactgtgggcttcacccaggaggagtggcagcacctggaccctagtcagagggctctgtatagagatgtgatgctggagaactacagcaaccttgtctcagtggggtattgtgctcacaaaccagaggtgatcttcaggctggaacaaggagaagaaccatggagactggaggaagaattcccaagccagagctttccag

SEQ ID NO: 202203 - DNA, 707 bp, Homo sapiens
  Payload ID: 19886
  Gene Name: zinc finger protein 33B
  ENST ID: ENST00000465206
  CDS Start-End: 1-282
cacctggaccctagtcagagggctctgtatagagatgtgatgctggagaactacagcaaccttgtctcagtggggtattgtgctcacaaaccagaggtgatcttcaggctggaacaaggagaagaaccatggagactggaggaagaattcccaagccagagctttccagaagtctggacagctgatcacctgaaagagaggagccaagaaaatcaatctaaacatttgtgggaagttgtattcatcaataatgaaatgctgactaaggaacaaggcccctgaggtgttcatgcactgatcctggaccttggattaaacccttgcagtgctggaagaagaggactctgcactgcctgccacaccaggactggaagatcaatggccttcccttcttccaaactaccttcccatgaggtggggatggtggtcacatctccaacactggcgtgctgtggaagagacatcagcattctctgcaacaaatttggaaacagcctaaagagacgtttctacttcaaagagatgcactgaggaagtgcactggcactgctggggactcacctggggcccagggctgaggcttctcgtgtccttggagctgctgtcctcccgaggagcgtccacactgcagccagctcagcctcaggtgtcctatctggttttgaaaccaaatctaagtgggaaaagaagattcaagttttatccga

SEQ ID NO: 202204 - DNA, 5843 bp, Homo sapiens
  Payload ID: 19886
  Gene Name: zinc finger protein 33B
  ENST ID: ENST00000613419
  CDS Start-End: 1-2337
atgtctgcagtagatcagaagttccaggggtcagtatcatttaaagatgtgactgtgggcttcacccaggaggagtggcagcacctggaccctagtcagagggctctgtatagagatgtgatgctggagaactacagcaaccttgtctcagtggggtattgtgctcacaaaccagaggtgatcttcaggctggaacaaggagaagaaccatggagactggaggaagaattcccaagccagagctttccagaagtctggacagctgatcacctgaaagagaggagccaagaaaatcaatctaaacatttgtgggaagttgtattcatcaataatgaaatgctgactaaggaacaaggtaatgtaataggaataccatttaacatggacgtaagttcttttccttccagaaaaatgttctgtcagtatgactcacgtggaatgagtttcaacactgtttcagaattggttatcagtaagataaactatttaggaaaaaagtctgacgaatttaatgcatgtgggaaattgttactcaatattaagcatgatgaaactcatactcgagagaaaaatgaagttttgaaaaataggaacactctgagtcatcgtgagaacactttgcagcatgagaagattcaaactttagaccacaattttgaatacagtatatgtcaggaaaccctccttgaaaaggcagtattcaatacacggaagagagagaatgcagaagagaataactgtgactataatgaatttgggagaactttctgtgatagttcatccctcttgttccatcagatacctccatcaaaggacagtcactatgaatttagtgattgtgagaagttcttatgtgtgaagtccaccctttctaaacatgatggggtacctgtgaaacactatgattgtggtgaaagtgggaataatttcaggaggaaattgtgtctgtcacagcttcagaaaggtgataaaggagagaaacactttgaatgtaatgaatgtgggaaagctttctgggagaagtcacatctcactcgacatcagagggtgcacacaggagagaaacactttcaatgtaatcaatgtggaaaaactttctgggagaagtcaaacctcactaaacatcagagatcacacacaggggagaaaccttttgaatgcaatgaatgtgggaaagcctttagccataagtcagccctcacattacaccagagaacacatacaggggagaaaccctatcagtgtaatgcatgtgggaaaactttttaccagaaatctgacctcactaaacatcagagaacacacacagggcagaaaccctatgaatgttatgaatgtggaaaatccttctgtatgaattcacaccttacagtacaccagagaactcacacaggtgagaaaccttttgaatgtcttgagtgtgggaaatccttttgtcaaaagtcacatcttacacagcatcagagaactcacataggagataaaccttatgaatgtaatgcatgtgggaaaactttctaccacaagtcagtactcaccaggcatcagataattcatacagggttgaaaccttatgaatgttatgaatgtgggaaaaccttctgcttgaagtcagacctcacaatacatcagagaacgcacacaggggagaaaccctttgcatgtcctgaatgtgggaaattctttagccataagtcaaccctctctcaacattatagaacacacacgggggagaaaccctatgaatgtcatgaatgtggaaaaatcttttacaataaatcatacctaacaaaacataatagaacacatacaggggagaaaccctatgaatgtaatgaatgtggaaaaaccttctgccagaagtcacaactcactcagcatcagagaattcacataggggagaaaccctatgaatgtaatgagtgtggaaaagctttctgccataagtcagctctaattgtacatcagagaacccatacacaagaaaagccttataaatgtaacgaatgtggaaaatctttctgtgtgaagtcaggacttattttacatgagagaaagcacacgggggagaaaccctatgaatgcaatgaatgtgggaaatccttcagtcacaaatcatcactcacagtacatcacagggctcacacaggagagaaatcttgtcagtgtaatgaatgtggaaaaatcttttaccgtaaatcagaccttgctaaacatcagagatcacatacaggggaaaagccctatgaatgtaacacatgcaggaaaaccttctctcaaaagtcaaatctcattgtacatcagagaacacacataggagaaaaaccttatgaatgaattggatattagaaatttccagccacaagtcagcctccataatgcctcagagtcttcacactgtggagaagggcctgttgacatcctgaatgttcaataactatccacaaactcgccttatgttactccaaagtaacagtaggggataaacccatagactacaacaactataggatggcttttgttaggaagtgatattctgttgaatatcagatggttaatactggcataaaacctcacagatttttttgaatttgtgaaagtttttggcaaaactacaaataggattatgttagcatttacactgaggagaaaattgtcaatttaagaaatctaaagtgaaaattttgcttagaaataaaatatgacaagttctgttttgagtttgatgccataatagtttttaaggtatctaacaataatttatagatgtacattgtggaatgtaaagctttaagaattttttaagaagtaataattaaaataacctcacaagaagttgtaatgagtacagagaattcccgtgtacccttcaccaagcttcctctaaggataatatataatcatagtatatggtcaagtccaagaaatcgatgttaccttgctagtagatgcagacttactcagattttgctatggtttgcgtgcactctgtgtgtgtacgtgtatgtgtgtgtgtgtggttataacaaactggtacttttacatttgagtaaccatcaacacaattagtttacagaatggaaaaggagtctgagatctgtactgtttcaggattacaaaggaatcaggatttagcctcaagtagttcccttgttgtattaataaccacaccctttctgcatccctgtccctggcatccacttgactatgaagctttttgtaaagcatagataaattgaataatcagggcaacagcattaagcacatctgtgaattatccctgaagttcataggacttacatatgtacaagtggtatgtgatataaatcgtgtgtttcatatgcataatggtatttaacgtaattgtgaataggaagtaggtatcctaatttagtagtggttacttcatcaggcccatcccaggtgtttgtcgtgtcctgaaacaatttaaatagagacccacagagctaatgtttatccatttaaaagttataaatcaaaataacagattatctgaaaaaaaatctatcctgtacgtgtgaagatctaggcctgcctccatgttactccctttctcttactacctgtggctcatcccatgccatgaactgcctggggtacatatgtgaacactccagccttcagcgtaagtgatagtccaaattttctttaagcagctgctctccaagacagggccctggaaagaggcccacacatacagcccagttgctgcccagggctgttggactgtcatttcattgctcattgtacccagacagggatctgggccttcagagacttttgagaatatgaagaggagggttgaggctggagaagagccagaatcaagctggcatggggcttttattgacagtgtgaagattgtacactacattacatgatcagatcatacaaataatctaagattttacagtctggtgaccctagattacacaagtaatctaagcttccactttggaaaactagaaaaagaagagcaaattaaatccaaagtaacctggaaaaaaattagagtaaaaatcagtgaaattgaaaagagaaaatcaataaaacccaaaactgttctttgaaaaggtgggtaaaattgataaacctctagctagattaagaaaaaacagaagacaaatactgctaataccaaaagtgaaagaggccatcatagctgatcctatggtcaccaaaaggattagaaagaaatatggacaactctgtccataaatttgataacttagctaaaatggatcaattccttgcaagatgcattctctcaaagctcataaaaggtagatctcagtaggcatatatatctattaaataaattgaagcagtaattaataaccttccaagaccaggcgcggtggctaaaaatacaaaaagttagccgggcgtggtggcatgcgtgtatagtccaagctactcaggaggctgaggcagaagaatcacttgaacctgggaggtggaggttgcagtgagccaagattgtgccactgtactccagcctgggtgacagagtgagactccatctcaataaaattaataataataaaaccttccaaaaaaagtgccgggaccaaatggattcactgatgtgcatttttcgagatacttaaggtagaaatgataccaagtctgtactgtctctttcagaaaataaaagcagggataacacttcccaaatcattttgtgaggccaggattaccctaataccaaagccaggcaaaaacattacaagaaaggaaaactacagatcaatatttccagtgaacacagatgcagaaatccttaaaatgttagcaaatcaggaatgcaagccttgttcaacatttgatattcagtgcaatccattgcatgcattagcagttcaaagattaaatatgatcatatcaataggtacagaaaaagcatttgacaaaatccaatatccattcatgataaaacctctcaacacagaaggaatacaggagaacttactcaatttgataaagaactactacaaaaaaccctacatctagcatcatccttgatgtttccaactaaatgctttcctactaagatcaggaacatggcaaggaacaccactgcttttcagcattgtactggaagtgctatctaatgcagtgataccaaaaaaaaaggaaataaaatgcacataaatttggaaggaggaaatacaactgtctttgttctcaaataacatgattgtctttgtagaaaattctaaataacaaaaacctgctgacattaataagcaattatagcagggttgtagaatgtagtcctcaggtatatgataaaaaagaattagacatcaagtcattaaaagacatataggaaccctaaatgcttattgttaagtgaaaaccaatctgaaaaggctttctatgttgtatgattgcaattatatgacattctgggagaggcaaaactatcgagcgagtcaaaggaccagtggttgctgagagttgaggggaaaggagggatggcaggtaggtgatttttaggacagtgaaagtactctgtagggtactgtaatttgtcaaaatgcagagaatggaaaacagtgaacggaaaacacagagtaaaccctagtgtcaactctggacttcagttaataacagtgtaccactattggctcatcaattgtaacaaatgaaccataatgatgcaagatgttaataattggggagcctgtggaggatgggagggttaaaggtttatatgagaattctctgtactttttgctcaatttttctgtaaccctaaagctgctctaaaaaatgaagtgtattaagtaaataaataagtaaataaccaaccaacc

SEQ ID NO: 202205 - DNA, 567 bp, Homo sapiens
  Payload ID: 19886
  Gene Name: zinc finger protein 33B
  ENST ID: ENST00000462075
  CDS Start-End: 1-111
agccaagaaaatcaatctaaacatttgtgggaagttgtattcatcaataatgaaatgctgactaaggaacaagatgtcatcagcctcaggagagagtggtatgtaccttgaaataactcaccgagacacaaacttgctgacttcttgtcctccatctcagagaagatatggaagatatgaaggatggagaaaaagaggaagaggaaatgtgatggtggagtgggtaacataaaaaagggaaggcaaataagtgtatgtgttttcagcggcttctcactttcttttggcccatcaaggaaaccaacacatccgaggagagtgctgataggctgctcttagccgggaccacacttgtgctttgaaaacaacccccaaaatccctgcaggcaattgaaggatgtcccgagaacatcctcccagggagcagatacccattctgtagaagctctaagcctgctgggctaagccctccataggccactttaatgaggaggagaggctgtaggtggtggtaggaccaccatgttgcatgacttttctgtgtgccccgtcttttgactctgtctc

SEQ ID NO: 202206 - DNA, 1901 bp, Homo sapiens
  Payload ID: 19887
  Gene Name: zinc finger protein 34
  Uniprot ID: Q8IZ26
  ENST ID: ENST00000343459
  CDS Start-End: 67-1749
ctgccgtgctgctcggcggcgctgaggccaaatagttgcatcacatgtatctaatccgagagtctcatgcttctgctcctcagtgaccagctcctgctcactgccctcagaaagcccaaccctcaggcaatggcggccttgttcctgtctgccccaccccaggccgaggtgaccttcgaggacgtggctgtgtacctctcccgggaggaatggggccgcctgggccctgctcagaggggcctctacagggacgtgatgctggagacctacgggaacctagtctcactgggagtaggacctgcaggccccaagcctggagtgatctcgcagttggagcgaggggatgagccctgggtcctggatgttcagggcacctctgggaaagagcacctgagagtcaacagcccagctcttgggaccagaactgagtacaaggagttgacttcacaggagacatttggtgaggaagatccccagggatctgagccagtagaagcctgtgaccacatcagtaagtcagaggggagcctggaaaagctagtggagcagagaggccccagggcagtcacactgaccaacggggagagcagcagggagtctgggggaaacctcaggttgctgtcaagacctgttcctgatcagagacctcacaaatgtgatatatgtgagcaaagttttgaacagagatcatatctcaacaaccataagcgtgtacacaggtcaaaaaaaacaaatacagttcgtaactctggggaaatcttcagtgcaaacttagttgttaaagaagatcagaaaattcctactgggaaaaaattgcattattgcagttactgtgggaaaacattcaggtacagtgccaaccttgtcaagcatcagcggcttcacactgaagagaagccctacaaatgtgatgagtgtgggaaagccttcagccagagctgcgagttcatcaatcaccgaaggatgcactcaggagagattccctaccggtgtgacgagtgtgggaagacattcacccggaggcccaacctcatgaagcaccagaggattcacactggggagaaaccctacaagtgtggggagtgtgggaagcactttagcgcctactcttccctgatttatcaccagagaatccacaccggagagaaaccctataaatgtaatgactgcgggaaagccttcagtgatggctcaatccttatccgacatcgtcggactcacaccggagagaagccatttgagtgcaaggaatgtggcaaaggctttacacaaagttctaaccttatccaacatcagagaattcacactggagagaaaccctataaatgtaatgaatgtgagaaagctttcattcaaaaaaccaaactcgtggaacatcagagaagccacactggagagaagccctatgaatgcaatgactgtggcaaagttttcagccaaagcacacacctcatccagcaccagagaatccacacaggagagaagccctacaagtgcagcgagtgtgggaaggccttccacaacagttccagactcatccaccaccagaggctgcaccacggagagaaaccctacagatgcagcgattgcaagaaagccttcagccagagcacgtacttgattcagcaccggaggatccacaccggggagaagccctacaagtgcagcgagtgtgggaaggccttccggcacagttccaacatgtgtcagcatcagcggattcacctccgggaggacttctccatgtaacagtggcgcggtgtccgagggcagagtccagctgagcacttcctgcatgcgcccccggcacctgactctgccctttatgtattatccacacgatgttttcacagagtgaaaggacgtttctcattaaacaaacctcttttcttaaatcaaaa

SEQ ID NO: 202207 - DNA, 1926 bp, Homo sapiens
  Payload ID: 19887
  Gene Name: zinc finger protein 34
  ENST ID: ENST00000429371
  CDS Start-End: 155-1774
ggccgaacgggcgaggttgggctgccgtgctgctcggcggcgctgaggccaaatagttgcatcacatgtatctaatccgagagtctcatgcttctggtagctcctcagtgaccagctcctgctcactgccctcagaaagcccaaccctcaggcaatggcggccttgttcctgtctgccccaccccaggccgaggtgaccttcgaggacgtggctgtgtacctctcccgggaggaatggggccgcctgggccctgctcagaggggcctctacagggacgtgatgctggagacctacgggaacctagtctcactgggagtaggacctgcaggccccaagcctggagtgatctcgcagttggagcgaggggatgagccctgggtcctggatgttcagggcacctctgggaaagagcacctgagagtcaacagcccagctcttgggaccagaactgagtacaaggagttgacttcacaggagacatttggtgaggaagatccccagggatctgagccagtagaagcctgtgaccacatcagtaagtcagaggggagcctggaaaagctagtggagcagagaggccccagggcagtcacactgaccaacggggagagcagcagggagtctgggggaaacctcaggttgctgtcaagacctgttcctgatcagagacctcacaaatgtgatatatgtgagcaaagttttgaacagagatcatatctcaacaaccataagcgtgtacacaggtcaaaaaaaacaaatacagttcgtaactctggggaaatcttcagtgcaaacttagttgttaaagaagatcagaaaattcctactgggaaaaaattgcattattgcagttactgtgggaaaacattcaggtacagtgccaaccttgtcaagcatcagcggcttcacactgaagagaagccctacaaatgtgatgagtgtgggaaagccttcagccagagctgcgagttcatcaatcaccgaaggatgcactcaggagagattccctaccggtgtgacgagtgtgggaagacattcacccggaggcccaacctcatgaagcaccagaggattcacactggggagaaaccctacaagtgtggggagtgtgggaagcactttagcgcctactcttccctgatttatcaccagagaatccacaccggagagaaaccctataaatgtaatgactgcgggaaagccttcagtgatggctcaatccttatccgacatcgtcggactcacaccggagagaagccatttgagtgcaaggaatgtggcaaaggctttacacaaagttctaaccttatccaacatcagagaattcacactggagagaaaccctataaatgtaatgaatgtgagaaagctttcattcaaaaaaccaaactcgtggaacatcagagaagccacactggagagaagccctatgaatgcaatgactgtggcaaagttttcagccaaagcacacacctcatccagcaccagagaatccacacaggagagaagccctacaagtgcagcgagtgtgggaaggccttccacaacagttccagactcatccaccaccagaggctgcaccacggagagaaaccctacagatgcagcgattgcaagaaagccttcagccagagcacgtacttgattcagcaccggaggatccacaccggggagaagccctacaagtgcagcgagtgtgggaaggccttccggcacagttccaacatgtgtcagcatcagcggattcacctccgggaggacttctccatgtaacagtggcgcggtgtccgagggcagagtccagctgagcacttcctgcatgcgcccccggcacctgactctgccctttatgtattatccacacgatgttttcacagagtgaaaggacgtttctcattaaacaaacctcttttcttaaatcaaaa

SEQ ID NO: 202208 - DNA, 903 bp, Homo sapiens
  Payload ID: 19887
  Gene Name: zinc finger protein 34
  ENST ID: ENST00000534337
  CDS Start-End: 110-903
aggccaaatagttgcatcacatgtatctaatccgagagtctcatgcttctggtagctcctcagtgaccagctcctgctcactgccctcagaaagcccaaccctcaggcaatggcggccttgttcctgtctgccccaccccaggccgaggtgaccttcgaggacgtggctgtgtacctctcccgggaggaatggggccgcctgggccctgctcagaggggcctctacagggacgtgatgctggagacctacgggaacctagtctcactggctcttgggaccagaactgagtacaaggagttgacttcacaggagacatttggtgaggaagatccccagggatctgagccagtagaagcctgtgaccacatcagtaagtcagaggggagcctggaaaagctagtggagcagagaggccccagggcagtcacactgaccaacggggagagcagcagggagtctgggggaaacctcaggttgctgtcaagacctgttcctgatcagagacctcacaaatgtgatatatgtgagcaaagttttgaacagagatcatatctcaacaaccataagcgtgtacacaggtcaaaaaaaacaaatacagttcgtaactctggggaaatcttcagtgcaaacttagttgttaaagaagatcagaaaattcctactgggaaaaaattgcattattgcagttactgtgggaaaacattcaggtacagtgccaaccttgtcaagcatcagcggcttcacactgaagagaagccctacaaatgtgatgagtgtgggaaagccttcagccagagctgcgagttcatcaatcaccgaaggatgcactcaggagagattccctaccggtgtgacgagtgtgggaagacattcacccggaggcccaacctcatgaagcacca

SEQ ID NO: 202209 - DNA, 582 bp, Homo sapiens
  Payload ID: 19887
  Gene Name: zinc finger protein 34
  ENST ID: ENST00000534445
  CDS Start-End: 108-582
tccgattggcggggagggagggccgaacgggcgaggttgggctgccgtgctgctcggcggcgctgaggccaaatagttgcatcacatgtatctaatccgagagtctcatgcttctgctcctcagtgaccagctcctgctcactgccctcagaaagcccaaccctcaggcaatggcggccttgttcctgtctgccccaccccaggccgaggtgaccttcgaggacgtggctgtgtacctctcccgggaggaatggggccgcctgggccctgctcagaggggcctctacagggacgtgatgctggagacctacgggaacctagtctcactggctcttgggaccagaactgagtacaaggagttgacttcacaggagacatttggtgaggaagatccccagggatctgagccagtagaagcctgtgaccacatcagtaagtcagaggggagcctggaaaagctagtggagcagagaggccccagggcagtcacactgaccaacggggagagcagcagggagtctgggggaaacctcaggttgctgtcaagacctgttcctgatcagagacctcacaaatgtgata

SEQ ID NO: 202210 - DNA, 3661 bp, Homo sapiens
  Payload ID: 19888
  Gene Name: zinc finger protein 341
  Uniprot ID: Q9BYN7
  ENST ID: ENST00000342427
  CDS Start-End: 366-2909
acgtgctgtgggaatgggggattctgtgtcagagctggggggtcgggtccggtgagatggggatgcggatttagataatagggatgggaagttccgcgtgtgcggcggatataaggtcggtgtagacttggtcgttcaagtgaggcggggtccacactcggtggcccggtgactgggttatcgagtggagccagggcagcccagagatgctggggtcccgcgagcctaggttgggtttccagggctgggggctcggcggcggctcctgggcgccccctggcggccccgactcaaccgccacggctcccacaatgctcgcgtagccgggcttcggttcctgtggcggcgacggcggcggctccaagatggcgcaggcgatctttgaggccctggagggaatggacaatcagaccgttctggctgtccagtcattattggatggccaaggagcagtccctgatccgacaggccagagtgtcaatgcgccccctgctatccagccattggatgacgaggatgtatttctctgcgggaagtgtaagaagcaattcaactcgctgccagcgtttatgacccacaagcgggaacagtgccaggggaatgcccccgccctggccacagtctcactggccaccaacagcatctacccaccttcggcagcacccacagcggtccagcaggccccaactcctgccaatcgccagatctccacatacatcacagtgcccccgtccccactgatccagaccctggtgcaggggaacatcttggtgagcgatgatgtgctcatgtctgccatgtcagccttcacatccctggaccagcccatgccccagggccccccacctgtgcagagcagcctgaacatgcattccgtgcccagctacctcacccagcctccacctcctcctccacctcctccaccactgcccccaccgccaccacctcagcctccaccacctccaccccagagcctgggcccccctgggcgtcccaaccctggtgggaacggtgtggtggaggtgtacagtgctgctgcgcccctggctgggagtggaacggtggagatccaggcactggggatgcagccctacccacccctagaggtgccaaaccagtgtgtggagcctccagtatatcccacccccacagtgtacagccctggcaaacagggattcaaacccaaaggaccaaaccccgccgcccccatgaccagcgccaccgggggcacggtggccacctttgactctccagcaacgctgaagacccgacgagctaaagctgcagggaagccaaaggctcagaaactcaagtgctcatactgtgacaagtcattcaccaaaaactttgacctgcagcagcacatccgaagccacaccggtgagaagcccttccagtgcattgcatgtggccgtgcctttgcccagaagtctaatgttaagaaacacatgcagacccacaaggtgtggcctccaggacacagtggtggcaccgtgtctcgaaactctgtgaccgtacaggtcatggccctgaaccccagcaggcaggaggacgaggaaagcacagggttgggccagcccctgccgggtgcgccacagccccaggccttgtccacagctggtgaggaagagggggacaagccggagtccaagcaggtggtcctcatcgacagctcctacctgtgccaattctgccccagcaaattcagcacctacttccagctcaagtctcacatgacccagcataagaatgagcaggtgtacaagtgtgtggtcaaaagctgtgcccagacgttcccaaagctcgacacatttctggagcacatcaagagccaccaggaggagctgagctaccgctgccacctctgcggcaaggacttcccctcgctgtacgacctgggcgtgcaccagtactcccacagcctcctgccacagcacagccccaagaaggacaatgccgtctacaagtgtgtcaaatgtgtcaacaaatactccacccctgaggccctggagcaccacctgcagaccgccactcacaacttcccctgcccacactgccagaaggtgtttccttgtgaacgctacctgcggcgtcatctgcccacccacggcagcgggggcaggttcaagtgccaagtgtgcaagaagttcttccggcgggagcattatctcaaactgcatgctcacatccactcgggtgagaagccctacaaatgctcagtgtgcgagtctgcgttcaaccgcaaggacaaactgaagagacacatgttgatccacgagcccttcaagaaatacaaatgccctttctcgacgcacacaggctgcagtaaggagttcaaccggccggacaagctgaaggcccacatcctctcccactctggcatgaagctccacaaatgcgccctgtgcagcaagtccttcagccgccgtgcccacctcgccgagcatcagcgcgcccacacgggcaactacaagttccgctgtgctggctgcgccaagggcttttcccgccacaaatacctcaaagatcaccgctgtcgtctcggcccccaaaaggacaaggacctgcaaacccggcggcccccccagaggagggcagccccccgcagttgcggcagtggtgggcgcaaggtgctgacccccttgcctgacccgctggggctggaggagctgaaggacacaggggctgggctggtgcccgaggctgtccccggcaagccgcccttcgcagagccggacgcggtgctgtccatcgttgtgggtggtgcggtgggcgcggaaactgagctggtggtacctggacacgctgaggggctgggctccaacctggctctggcggagctgcaggctggggccgagggcccatgtgccatgctcgctgtgcccgtctacatccaggcctccgagtgacggacctgaggtgtctgtttcctgggcaggcctgatgctcctgtttgggtccagggcccctgggggcagaccggtgatccttaccagtggaagcgagccatcgagccattggcagaaatcctgctgaatgtcattcagaaacctcagcccatggtcgccctcctgtgcccctctcctgccggaaagccctgcaacattctagggttgggggcagggccatccacggtttctgggcagagccatggtggcaggagagagatggctgaagcctgagcagcccagagtcccgctggtctaggctggtggtcggggcccctgggagaggagacagggcattcctccccactctgtctccaggctgcctctgggtagcctctagtctgctgttcttcaggaggcctgccataaactcttcggagtttacgtgttgcaccttttcacagacggttccccacagcatcctcagacagctctgtgatgtagcttttaggaggcactcaggtgtcacggctagactgcagctatgagacagatctggcttcaaatccaagagttgccatgcacttgctgtgtgaccttgggcaagtcacttcacttctctgagccccgtgttcctcatctgtacaatggggcttacgatactactacctcatagggttgtcctggggatccagtatgatgaagtgcgccaggggcttggcatggtgcccggcacgcagaaagtgctcaataaatgtttttgtcataacgtg

SEQ ID NO: 202211 - DNA, 3579 bp, Homo sapiens
  Payload ID: 19888
  Gene Name: zinc finger protein 341
  Uniprot ID: Q9BYN7
  ENST ID: ENST00000375200
  CDS Start-End: 263-2827
ggcggatataaggtcggtgtagacttggtcgttcaagtgaggcggggtccacactcggtggcccggtgactgggttatcgagtggagccagggcagcccagagatgctggggtcccgcgagcctaggttgggtttccagggctgggggctcggcggcggctcctgggcgccccctggcggccccgactcaaccgccacggctcccacaatgctcgcgtagccgggcttcggttcctgtggcggcgacggcggcggctccaagatggcgcaggcgatctttgaggccctggagggaatggacaatcagaccgttctggctgtccagtcattattggatggccaaggagcagtccctgatccgacaggccagagtgtcaatgcgccccctgctatccagccattggatgacgaggatgtatttctctgcgggaagtgtaagaagcaattcaactcgctgccagcgtttatgacccacaagcgggaacagtgccaggggaatgcccccgccctggccacagtctcactggccaccaacagcatctacccaccttcggcagcacccacagcggtccagcaggccccaactcctgccaatcgccagatctccacatacatcacagtgcccccgtccccactgatccagaccctggtgcaggggaacatcttggtgagcgatgatgtgctcatgtctgccatgtcagccttcacatccctggaccagcccatgccccagggccccccacctgtgcagagcagcctgaacatgcattccgtgcccagctacctcacccagcctccacctcctcctccacctcctccaccactgcccccaccgccaccacctcagcctccaccacctccaccccagagcctgggcccccctgggcgtcccaaccctggtgggaacggtgtggtggaggtgtacagtgctgctgcgcccctggctgggagtggaacggtggagatccaggcactggggatgcagccctacccacccctagaggtgccaaaccagtgtgtggagcctccagtatatcccacccccacagtgtacagccctggcaaacagggattcaaacccaaaggaccaaaccccgccgcccccatgaccagcgccaccgggggcacggtggccacctttgactctccagcaacgctgaagacccgacgagctaaaggtgccaggggactcccggaagctgcagggaagccaaaggctcagaaactcaagtgctcatactgtgacaagtcattcaccaaaaactttgacctgcagcagcacatccgaagccacaccggtgagaagcccttccagtgcattgcatgtggccgtgcctttgcccagaagtctaatgttaagaaacacatgcagacccacaaggtgtggcctccaggacacagtggtggcaccgtgtctcgaaactctgtgaccgtacaggtcatggccctgaaccccagcaggcaggaggacgaggaaagcacagggttgggccagcccctgccgggtgcgccacagccccaggccttgtccacagctggtgaggaagagggggacaagccggagtccaagcaggtggtcctcatcgacagctcctacctgtgccaattctgccccagcaaattcagcacctacttccagctcaagtctcacatgacccagcataagaatgagcaggtgtacaagtgtgtggtcaaaagctgtgcccagacgttcccaaagctcgacacatttctggagcacatcaagagccaccaggaggagctgagctaccgctgccacctctgcggcaaggacttcccctcgctgtacgacctgggcgtgcaccagtactcccacagcctcctgccacagcacagccccaagaaggacaatgccgtctacaagtgtgtcaaatgtgtcaacaaatactccacccctgaggccctggagcaccacctgcagaccgccactcacaacttcccctgcccacactgccagaaggtgtttccttgtgaacgctacctgcggcgtcatctgcccacccacggcagcgggggcaggttcaagtgccaagtgtgcaagaagttcttccggcgggagcattatctcaaactgcatgctcacatccactcgggtgagaagccctacaaatgctcagtgtgcgagtctgcgttcaaccgcaaggacaaactgaagagacacatgttgatccacgagcccttcaagaaatacaaatgccctttctcgacgcacacaggctgcagtaaggagttcaaccggccggacaagctgaaggcccacatcctctcccactctggcatgaagctccacaaatgcgccctgtgcagcaagtccttcagccgccgtgcccacctcgccgagcatcagcgcgcccacacgggcaactacaagttccgctgtgctggctgcgccaagggcttttcccgccacaaatacctcaaagatcaccgctgtcgtctcggcccccaaaaggacaaggacctgcaaacccggcggcccccccagaggagggcagccccccgcagttgcggcagtggtgggcgcaaggtgctgacccccttgcctgacccgctggggctggaggagctgaaggacacaggggctgggctggtgcccgaggctgtccccggcaagccgcccttcgcagagccggacgcggtgctgtccatcgttgtgggtggtgcggtgggcgcggaaactgagctggtggtacctggacacgctgaggggctgggctccaacctggctctggcggagctgcaggctggggccgagggcccatgtgccatgctcgctgtgcccgtctacatccaggcctccgagtgacggacctgaggtgtctgtttcctgggcaggcctgatgctcctgtttgggtccagggcccctgggggcagaccggtgatccttaccagtggaagcgagccatcgagccattggcagaaatcctgctgaatgtcattcagaaacctcagcccatggtcgccctcctgtgcccctctcctgccggaaagccctgcaacattctagggttgggggcagggccatccacggtttctgggcagagccatggtggcaggagagagatggctgaagcctgagcagcccagagtcccgctggtctaggctggtggtcggggcccctgggagaggagacagggcattcctccccactctgtctccaggctgcctctgggtagcctctagtctgctgttcttcaggaggcctgccataaactcttcggagtttacgtgttgcaccttttcacagacggttccccacagcatcctcagacagctctgtgatgtagcttttaggaggcactcaggtgtcacggctagactgcagctatgagacagatctggcttcaaatccaagagttgccatgcacttgctgtgtgaccttgggcaagtcacttcacttctctgagccccgtgttcctcatctgtacaatggggcttacgatactactacctcatagggttgtcctggggatccagtatgatgaagtgcgccaggggcttggcatggtgcccggcacgcagaaagtgctcaataaatgtttttgtcataacgtg

SEQ ID NO: 202212 - DNA, 3232 bp, Homo sapiens
  Payload ID: 19888
  Gene Name: zinc finger protein 341
  ENST ID: ENST00000483118
  CDS Start-End: 13-1827
ggcggctccaagatggcgcaggcgatctttgaggccctggagggaatggacaatcagaccgttctggctgtccagtcattattggatggccaaggagcagtccctgatccgacaggccagagtgtcaatgcgccccctgctatccagccattggatgacgaggatgtatttctctgcgggaagtgtaagaagcaattcaactcgctgccagcgtttatgacccacaagcgggaacagtgccaggggaatgcccccgccctggccacagtctcactggccaccaacagcatctacccaccttcggcagcacccacagcggtccagcaggccccaactcctgccaatcgccagatctccacatacatcacagtgcccccgtccccactgatccagaccctggtgcaggggaacatcttggtgagcgatgatgtgctcatgtctgccatgtcagccttcacatccctggaccagcccatgccccagggccccccacctgtgcagagcagcctgaacatgcattccgtgcccagctacctcacccagcctccacctcctcctccacctcctccaccactgcccccaccgccaccacctcagcctccaccacctccaccccagagcctgggcccccctgggcgtcccaaccctggtgggaacggtgtggtggaggtgtacagtgctgctgcgcccctggctgggagtggaacggtggagatccaggcactggggatgcagccctacccacccctagaggtgccaaaccagtgtgtggagcctccagtatatcccacccccacagtgtacagccctggcaaacagggattcaaacccaaaggaccaaaccccgccgcccccatgaccagcgccaccgggggcacggtggccacctttgactctccagcaacgctgaagacccgacgagctaaaggtgccaggggactcccggaagctgcagggaagccaaaggctcagaaactcaagtgctcatactgtgacaagtcattcaccaaaaactttgacctgcagcagcacatccgaagccacaccggtgagaagcccttccagtgcattgcatgtggccgtgcctttgcccagaagtctaatgttaagaaacacatgcagacccacaaggtgtggcctccaggacacagtggtggcaccgtgtctcgaaactctgtgaccgtacaggtcatggccctgaaccccagcaggcaggaggacgaggaaagcacagggttgggccagcccctgccgggtgcgccacagccccaggccttgtccacagctggtgaggaagagggggacaagccggagtccaagcaggtggtcctcatcgacagctcctacctgtgccaattctgccccagcaaattcagcacctacttccagctcaagtctcacatgacccagcataagaatgagcaggtgtacaagtgtgtggtcaaaagctgtgcccagacgttcccaaagctcgacacatttctggagcacatcaagagccaccaggaggagctgagctaccgctgccacctctgcggcaaggacttcccctcgctgtacgacctgggcgtgcaccagtactcccacagcctcctgccacagcacagccccaagaaggacaatgccgtctacaagtgtttccttgtgaacgctacctgcggcgtcatctgcccacccacggcagcgggggcaggttcaagtgccaagtgtgcaagaagttcttccggcgggagcattatctcaaactgcatgctcacatccactcgggtgagaagccctacaaatgctcagtgtgcgagtctgcgttcaaccgcaaggacaaactgaagagacacatgttgatccacgagcccttcaagaaatacaaatgccctttctcgacgcacacaggctgcagtaaggagttcaaccggccggacaagctgaaggcccacatcctctcccactctggcatgaagctccacaaatgcgccctgtgcagcaagtccttcagccgccgtgcccacctcgccgagcatcagcgcgcccacacgggcaactacaagttccgctgtgctggctgcgccaagggcttttcccgccacaaatacctcaaagatcaccgctgtcgtctcggcccccaaaaggacaaggacctgcaaacccggcggcccccccagaggagggcagccccccgcagttgcggcagtggtgggcgcaaggtgctgacccccttgcctgacccgctggggctggaggagctgaaggacacaggggctgggctggtgcccgaggctgtccccggcaagccgcccttcgcagagccggacgcggtgctgtccatcgttgtgggtggtgcggtgggcgcggaaactgagctggtggtacctggacacgctgaggggctgggctccaacctggctctggcggagctgcaggctggggccgagggcccatgtgccatgctcgctgtgcccgtctacatccaggcctccgagtgacggacctgaggtgtctgtttcctgggcaggcctgatgctcctgtttgggtccagggcccctgggggcagaccggtgatccttaccagtggaagcgagccatcgagccattggcagaaatcctgctgaatgtcattcagaaacctcagcccatggtcgccctcctgtgcccctctcctgccggaaagccctgcaacattctagggttgggggcagggccatccacggtttctgggcagagccatggtggcaggagagagatggctgaagcctgagcagcccagagtcccgctggtctaggctggtggtcggggcccctgggagaggagacagggcattcctccccactctgtctccaggctgcctctgggtagcctctagtctgctgttcttcaggaggcctgccataaactcttcggagtttacgtgttgcaccttttcacagacggttccccacagcatcctcagacagctctgtgatgtagcttttaggaggcactcaggtgtcacggctagactgcagctatgagacagatctggcttcaaatccaagagttgccatgcacttgctgtgtgaccttgggcaagtcacttcacttctctgagccccgtgttcctcatctgtacaatggggcttacgatactactacctcatagggttgtcctggggatccagtatgatgaagtgcgccaggggcttggcatggtgcccggcacgcagaaagtgctcaataaatgtttttgtcataacgtg

SEQ ID NO: 202213 - DNA, 3140 bp, Homo sapiens
  Payload ID: 19888
  Gene Name: zinc finger protein 341
  ENST ID: ENST00000497876
  CDS Start-End: 21-239
gcgacggcggcggctccaagatggcgcaggcgatctttgaggccctggagggaatggacaatcagaccgttctggctgtccagtcattattggatggccaaggagcagtccctgatccgacaggccagagtgtcaatgcgccccctgctatccagccattggatctccacatacatcacagtgcccccgtccccactgatccagaccctggtgcaggggaacatcttggtgagcgatgatgtgctcatgtctgccatgtcagccttcacatccctggaccagcccatgccccagggccccccacctgtgcagagcagcctgaacatgcattccgtgcccagctacctcacccagcctccacctcctcctccacctcctccaccactgcccccaccgccaccacctcagcctccaccacctccaccccagagcctgggcccccctgggcgtcccaaccctggtgggaacggtgtggtggaggtgtacagtgctgctgcgcccctggctgggagtggaacggtggagatccaggcactggggatgcagccctacccacccctagaggtgccaaaccagtgtgtggagcctccagtatatcccacccccacagtgtacagccctggcaaacagggattcaaacccaaaggaccaaaccccgccgcccccatgaccagcgccaccgggggcacggtggccacctttgactctccagcaacgctgaagacccgacgagctaaaggtgccaggggactcccggaagctgcagggaagccaaaggctcagaaactcaagtgctcatactgtgacaagtcattcaccaaaaactttgacctgcagcagcacatccgaagccacaccggtgagaagcccttccagtgcattgcatgtggccgtgcctttgcccagaagtctaatgttaagaaacacatgcagacccacaaggtgtggcctccaggacacagtggtggcaccgtgtctcgaaactctgtgaccgtacaggtcatggccctgaaccccagcaggcaggaggacgaggaaagcacagggttgggccagcccctgccgggtgcgccacagccccaggccttgtccacagctggtgaggaagagggggacaagccggagtccaagcaggtggtcctcatcgacagctcctacctgtgccaattctgccccagcaaattcagcacctacttccagctcaagtctcacatgacccagcataagaatgagcaggtgtacaagtgtgtggtcaaaagctgtgcccagacgttcccaaagctcgacacatttctggagcacatcaagagccaccaggaggagctgagctaccgctgccacctctgcggcaaggacttcccctcgctgtacgacctgggcgtgcaccagtactcccacagcctcctgccacagcacagccccaagaaggacaatgccgtctacaagtgtgtcaaatgtgtcaacaaatactccacccctgaggccctggagcaccacctgcagaccgccactcacaacttcccctgcccacactgccagaaggtgtttccttgtgaacgctacctgcggcgtcatctgcccacccacggcagcgggggcaggttcaagtgccaagtgtgcaagaagttcttccggcgggagcattatctcaaactgcatgctcacatccactcgggtgagaagccctacaaatgctcagtgtgcgagtctgcgttcaaccgcaaggacaaactgaagagacacatgttgatccacgagcccttcaagaaatacaaatgccctttctcgacgcacacaggctgcagtaaggagttcaaccggccggacaagctgaaggcccacatcctctcccactctggcatgaagctccacaaatgcgccctgtgcagcaagtccttcagccgccgtgcccacctcgccgagcatcagcgcgcccacacgggcaactacaagttccgctgtgctggctgcgccaagggcttttcccgccacaaatacctcaaagatcaccgctgtcgtctcggcccccaaaaggacaaggacctgcaaacccggcggcccccccagaggagggcagccccccgcagttgcggcagtggtgggcgcaaggtgctgacccccttgcctgacccgctggggctggaggagctgaaggacacaggggctgggctggtgcccgaggctgtccccggcaagccgcccttcgcagagccggacgcggtgctgtccatcgttgtgggtggtgcggtgggcgcggaaactgagctggtggtacctggacacgctgaggggctgggctccaacctggctctggcggagctgcaggctggggccgagggcccatgtgccatgctcgctgtgcccgtctacatccaggcctccgagtgacggacctgaggtgtctgtttcctgggcaggcctgatgctcctgtttgggtccagggcccctgggggcagaccggtgatccttaccagtggaagcgagccatcgagccattggcagaaatcctgctgaatgtcattcagaaacctcagcccatggtcgccctcctgtgcccctctcctgccggaaagccctgcaacattctagggttgggggcagggccatccacggtttctgggcagagccatggtggcaggagagagatggctgaagcctgagcagcccagagtcccgctggtctaggctggtggtcggggcccctgggagaggagacagggcattcctccccactctgtctccaggctgcctctgggtagcctctagtctgctgttcttcaggaggcctgccataaactcttcggagtttacgtgttgcaccttttcacagacggttccccacagcatcctcagacagctctgtgatgtagcttttaggaggcactcaggtgtcacggctagactgcagctatgagacagatctggcttcaaatccaagagttgccatgcacttgctgtgtgaccttgggcaagtcacttcacttctctgagccccgtgttcctcatctgtacaatggggcttacgatactactacctcatagggttgtcctggggatccagtatgatgaagtgcgccaggggcttggcatggtgcccggcacgcagaaagtgctcaataaatgtttttgtcataacgtg

SEQ ID NO: 202214 - DNA, 3632 bp, Homo sapiens
  Payload ID: 19889
  Gene Name: zinc finger protein 343
  Uniprot ID: Q6P1L6
  ENST ID: ENST00000278772
  CDS Start-End: 489-2288
gtagtcttttttttgcagaatgggccaaggggacagagacttcactcgggagccagaacctgttttcaacatgggtattttaagaagagacggagaggctgtcactgcagtggtcactgtcctggaaaagtaaccgttgcacggcccagaagtggctctgtggcggccaatgggagccgaagcctgcgaggatgttgggaattgtagttctggcgtcggtcggtggccgagatcccgggcacgctggctctggtccaccttctccaatccctgcctgctgggagaggacgatctcttgagaaaggaaagacttctgtgctcccgagaacttcctatcaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattggcagaaccaaagccagaaatctacacttgttcctcctgccttctggccttctcctgtcagcagttcctcagtcaacatgtacttcagatcttcctgggcttatgtgcagaaaatcacttccatccagggaattctagcccagggcattggaaacagcaggggcagcagtattcccatgtaagctgttggtttgaaaatgcagaaggtcaggagagaggaggtggctccaaaccctggtctgcaaggacagaggagagagaaacctcaagggcattccccagcccactccaaagacagtcagcaagtcctagaaaaggcaacatggtggtagaaacagagcccagctcagcccaaagaccaaaccctgtgcagctagacaaaggcttgaaggaattagaaaccttgagatttggagcaatcaactgtagagagtatgaaccggaccataacctggaatcaaactttattacaaacccgaggaccctcttagggaagaagccctacatttgcagtgattgtgggcgaagctttaaagatagatcaaccctcatcagacaccatcgtatacactcgatggagaagccttatgtgtgcagtgagtgcgggcgaggttttagccagaagtccaacctcagcagacaccagagaacacattcagaagagaagccttatttgtgcagggagtgtgggcaaagctttagaagtaagtccatcctcaatagacatcagtggactcactcagaggagaagccctatgtttgcagcgagtgtgggcgaggctttagcgagaagtcatccttcatcagacaccagaggacacactccggtgagaaaccctatgtgtgcctggagtgtggacgaagcttttgtgataagtcaaccctcagaaaacaccagaggatacactcaggggagaagccttatgtttgcagggagtgtgggcgaggctttagccagaactcagatctcatcaaacaccagaggacacacttggatgagaagccttatgtttgcagggagtgtgggcgaggcttttgtgacaagtcaaccctcatcatacacgagcggacgcactctggagagaagccttatgtgtgtggtgagtgtggccgaggctttagtcggaaatcactcctccttgtccaccagaggacacactcaggggagaagcattatgtctgcagggagtgtaggcgaggttttagccagaagtcaaatctcatcagacaccagaggacgcactcaaatgagaagccttatatttgcagggaatgtgggcgaggcttttgtgacaagtcaaccctcattgtacatgagaggacacactcaggagagaagccttacgtgtgcagtgagtgtggccgaggctttagccggaaatcactcctccttgtccaccagaggacacactcaggggagaagcattatgtttgtagggagtgtgggcgaggctttagtcataagtcaaatctcatcagacaccagaggacacactgacgggagaaacctgtgtatgcaggggtcatgaacaagacctgagtgaccagtcaagcctcatgttaccccagagagacacatggggagtagaccctgtgtacacagattgtgagtgaagttccagagatgtgtcagcccttatcaggcatgggagggacacgttcaggagaggagccttatgagtatagagtacgggcaactgtagccatcagtcagccttgagcatgcacaaaaggacacacttaggagagaagtttatgtgtagggactgtgggaaggctttagcaataatcaacatttaccagacatccaatgacagcctcaggggaaagcacccttgtctggggagtgttggggagcatcagtaaaagaatggacactcaggcacagagtggccctcaggaaggaggtctttgtttgtaggatgtatgggcaaagcttttgtgatcacacaccacagggagaatctgcatgtggggacactgtggagctctgcccagatgaccttttcaggggtaacaccccagctgcttgagagaacagtgttgctgctggcagagatgcattccagagatgcactccgctctggaactcactctcagccacagggagctgcatgcaccacaggggcaatgcacctttgcaggggtaccttctggccccaacccttgactcaacggggacaactccagaaggtcattccagatccagagatccccatcgaactgaaggatcactgggttgcagacacattgcaggtcagcttcttcctctgcccagtcctgccctcactccccagtgaatcctcaattttctgtctcgttgtctgtccagataattgattctaagacatgttaggtatataaggagtgtagataaggcttcagccatgagtcaccccgcagtaagccccagagtatattgaatagaaattctgcatgtgtggggagaatggacaaggacttaggaaaaagtcctcatcaaagaacagcttttttgggacaagctttacatgggtggggagggaaaatgtgaaacacattagcaataagttaaacctcatcttgtactaaaggaggacacactcagggagaagacctctgtgggcagggcttgtgggtggagcttcatcccgatgtcactcctcaactgacttaggaggacagtcttgctaccccaagtcactacctcactcacctctgagggattttcaggaaatgtcttgactcccccatgtactctgtatgtgagcgaagatggcagtaactgttaaataagcattcttttctacttcttggaatcagatgaaataaaaaagcaggctttatttaagtaatcaaaaaa

SEQ ID NO: 202215 - DNA, 771 bp, Homo sapiens
  Payload ID: 19889
  Gene Name: zinc finger protein 343
  Uniprot ID: Q6P1L6
  ENST ID: ENST00000358413
  CDS Start-End: 415-771
tgcgattcggggcaggggcaggcagtggggggacagcctggaaccagaacgcgaaacccagcctcacggtccaccttctccaatccctgcctgctgggagaggacgatctcttgagaaaggaaagacttctgtgctcccgagaacttcctatcagtagaaccacagtccctcttcggacatgctgttctcagaacaaaagaaatggtggaattatgcaatgcttagaaatggcatcgtcgctttcactcacattcattttccaaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattgggtcaggagatcgagaccatcctggccaacatagtgaaatcccatctctactaa

SEQ ID NO: 202216 - DNA, 819 bp, Homo sapiens
  Payload ID: 19889
  Gene Name: zinc finger protein 343
  Uniprot ID: Q6P1L6
  ENST ID: ENST00000381253
  CDS Start-End: 272-628
ggtcggtggccgagatcccgggcacgctggctctggtccaccttctccaatccctgcctgctgggagaggacgatctcttgagaaaggaaagacttctgtgctcccgagaacttcctatcaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattgggtcaggagatcgagaccatcctggccaacatagtgaaatcccatctctactaaaaatacaaaaattagctgagcatggtggcatgtgcctgtaatctcagctacttgggagcctgaggcaggagaatcacttgaaccagggagtcagaggttgcagtgagccgagattgtgccgttgcactccagcctggtgacagagtgaaactcagtctgaaaaaataaaaaaaaataaaaaaatatttaaa

SEQ ID NO: 202217 - DNA, 1028 bp, Homo sapiens
  Payload ID: 19889
  Gene Name: zinc finger protein 343
  ENST ID: ENST00000445484
  CDS Start-End: 595-1028
cctttctgaaaggcctccagatcctctgcgaaggccccctgggctcccccggcggggcccgcagctctcccccgcgctgaatctgaggaactgggcccggaagctcgcgagtctcggtcctggcggttcgggcgggcgccccctgttggccaagttgggacttgccattgcggcaaaacctgcgattcggggcaggggcaggcagtggggggacagcctggaaccagaacgcgaaacccagcctcacggtccaccttctccaatccctgcctgctgggagaggacgatctcttgagaaaggaaagacttctgtgctcccgagaacttcctatcagtagaaccacagtccctcttcggacatgctgttctcagaacaaaagaaatggtggaattatgcaatgcttagaaatggcatcgtcgctttcactcacattcattttccaaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattggcagaaccaaagccagaaatctacacttgttcctcctgccttctggccttctcctgtcagcagttcctcagtcaacatgtacttcagatcttcctgggcttatgtgcagaaaatcacttccatccagggaa

SEQ ID NO: 202218 - DNA, 642 bp, Homo sapiens
  Payload ID: 19889
  Gene Name: zinc finger protein 343
  ENST ID: ENST00000421216
  CDS Start-End: 339-642
atcccgggcacgctggctctggtgagcgcggcctccgcggctccttggccccaggatgccctctctcgtggggaaaggagggtcgggaaaggccgagcgtaggtccaccttctccaatccctgcctgctgggagaggacgatctcttgagaaaggaaagacttctgtgctcccgagaacttcctatcaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattgg

SEQ ID NO: 202219 - DNA, 3675 bp, Homo sapiens
  Payload ID: 19889
  Gene Name: zinc finger protein 343
  ENST ID: ENST00000612935
  CDS Start-End: 415-2337
tgcgattcggggcaggggcaggcagtggggggacagcctggaaccagaacgcgaaacccagcctcacggtccaccttctccaatccctgcctgctgggagaggacgatctcttgagaaaggaaagacttctgtgctcccgagaacttcctatcagtagaaccacagtccctcttcggacatgctgttctcagaacaaaagaaatggtggaattatgcaatgcttagaaatggcatcgtcgctttcactcacattcattttccaaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattggatggagtttcgctcttgttgcccaggctagagtgcaatcgtgcaatctcggctcaccacaacctttgcctcccgggttcaagcaattctcctgccacagcctctcgagtagttgggattacagcagaaccaaagccagaaatctacacttgttcctcctgccttctggccttctcctgtcagcagttcctcagtcaacatgtacttcagatcttcctgggcttatgtgcagaaaatcacttccatccagggaattctagcccagggcattggaaacagcaggggcagcagtattcccatgtaagctgttggtttgaaaatgcagaaggtcaggagagaggaggtggctccaaaccctggtctgcaaggacagaggagagagaaacctcaagggcattccccagcccactccaaagacagtcagcaagtcctagaaaaggcaacatggtggtagaaacagagcccagctcagcccaaagaccaaaccctgtgcagctagacaaaggcttgaaggaattagaaaccttgagatttggagcaatcaactgtagagagtatgaaccggaccataacctggaatcaaactttattacaaacccgaggaccctcttagggaagaagccctacatttgcagtgattgtgggcgaagctttaaagatagatcaaccctcatcagacaccatcgtatacactcgatggagaagccttatgtgtgcagtgagtgcgggcgaggttttagccagaagtccaacctcagcagacaccagagaacacattcagaagagaagccttatttgtgcagggagtgtgggcaaagctttagaagtaagtccatcctcaatagacatcagtggactcactcagaggagaagccctatgtttgcagcgagtgtgggcgaggctttagcgagaagtcatccttcatcagacaccagaggacacactccggtgagaaaccctatgtgtgcctggagtgtggacgaagcttttgtgataagtcaaccctcagaaaacaccagaggatacactcaggggagaagccttatgtttgcagggagtgtgggcgaggctttagccagaactcagatctcatcaaacaccagaggacacacttggatgagaagccttatgtttgcagggagtgtgggcgaggcttttgtgacaagtcaaccctcatcatacacgagcggacgcactctggagagaagccttatgtgtgtggtgagtgtggccgaggctttagtcggaaatcactcctccttgtccaccagaggacacactcaggggagaagcattatgtctgcagggagtgtaggcgaggttttagccagaagtcaaatctcatcagacaccagaggacgcactcaaatgagaagccttatatttgcagggaatgtgggcgaggcttttgtgacaagtcaaccctcattgtacatgagaggacacactcaggagagaagccttacgtgtgcagtgagtgtggccgaggctttagccggaaatcactcctccttgtccaccagaggacacactcaggggagaagcattatgtttgtagggagtgtgggcgaggctttagtcataagtcaaatctcatcagacaccagaggacacactgacgggagaaacctgtgtatgcaggggtcatgaacaagacctgagtgaccagtcaagcctcatgttaccccagagagacacatggggagtagaccctgtgtacacagattgtgagtgaagttccagagatgtgtcagcccttatcaggcatgggagggacacgttcaggagaggagccttatgagtatagagtacgggcaactgtagccatcagtcagccttgagcatgcacaaaaggacacacttaggagagaagtttatgtgtagggactgtgggaaggctttagcaataatcaacatttaccagacatccaatgacagcctcaggggaaagcacccttgtctggggagtgttggggagcatcagtaaaagaatggacactcaggcacagagtggccctcaggaaggaggtctttgtttgtaggatgtatgggcaaagcttttgtgatcacacaccacagggagaatctgcatgtggggacactgtggagctctgcccagatgaccttttcaggggtaacaccccagctgcttgagagaacagtgttgctgctggcagagatgcattccagagatgcactccgctctggaactcactctcagccacagggagctgcatgcaccacaggggcaatgcacctttgcaggggtaccttctggccccaacccttgactcaacggggacaactccagaaggtcattccagatccagagatccccatcgaactgaaggatcactgggttgcagacacattgcaggtcagcttcttcctctgcccagtcctgccctcactccccagtgaatcctcaattttctgtctcgttgtctgtccagataattgattctaagacatgttaggtatataaggagtgtagataaggcttcagccatgagtcaccccgcagtaagccccagagtatattgaatagaaattctgcatgtgtggggagaatggacaaggacttaggaaaaagtcctcatcaaagaacagcttttttgggacaagctttacatgggtggggagggaaaatgtgaaacacattagcaataagttaaacctcatcttgtactaaaggaggacacactcagggagaagacctctgtgggcagggcttgtgggtggagcttcatcccgatgtcactcctcaactgacttaggaggacagtcttgctaccccaagtcactacctcactcacctctgagggattttcaggaaatgtcttgactcccccatgtactctgtatgtgagcgaagatggcagtaactgttaaataagcattcttttctacttcttggaatcagatgaaataaaaaagcaggctttatttaagtaatc

SEQ ID NO: 202220 - DNA, 3300 bp, Homo sapiens
  Payload ID: 19889
  Gene Name: zinc finger protein 343
  Uniprot ID: Q6P1L6
  ENST ID: ENST00000617391
  CDS Start-End: 433-1962
gtagtcttttttttgcagaatgggccaaggggacagagacttcactcgggagccagaacctgttttcaacatgggtattttaagaagagacggagaggctgtcactgcagtggtcactgtcctggaaaagtaaccgttgcacggcccagaagtggctctgtggcggccaatgggagccgaagcctgcgaggatgttgggaattgtagttctggcgtcggtcggtggccgagatcccgggcacgctggctctggtccaccttctccaatccctgcctgctgggagaggacgatctcttgagaaaggaaagacttctgtgctcccgagaacttcctatcaggtaccagttacattcagggatgtgactgtgatcttcacagaagcagaatggaagagactgagtccagagcagaggaatctatacaaagaagtgatgctggagaattacaggaatcttctctcattggcagaaccaaagccagaaatctacacttgttcctcctgccttctggccttctcctgtcagcagttcctcagtcaacatgtacttcagatcttcctgggcttatgtgcagaaaatcacttccatccagggaattctagcccagggcattggaaacagcaggggcagcagtattcccatgtaagctgttggtttgaaaatgcagaaggtcaggagagaggaggtggctccaaaccctggtctgcaaggacagaggagagagaaacctcaagggcattccccagcccactccaaagacagtcagcaagtcctagaaaaggcaacatggtggtagaaacagagcccagctcagcccaaagaccaaaccctgtgcagctagacaaaggcttgaaggaattagaaaccttgagatttggagcaatcaactgtagagagtatgaaccggaccataacctggaatcaaactttattacaaacccgaggaccctcttagggaagaagccctacatttgcagtgattgtgggcgaagctttaaagatagatcaaccctcatcagacaccatcgtatacactcgatggagaagccttatgtgtgcagtgagtgcgggcgaggttttagccagaagtccaacctcagcagacaccagagaacacattcagaagagaagccttatttgtgcagggagtgtgggcaaagctttagaagtaagtccatcctcaatagacatcagtggactcactcagaggagaagccctatgtttgcagcgagtgtgggcgaggctttagcgagaagtcatccttcatcagacaccagaggacacactccggtgagaaaccctatgtgtgcctggagtgtggacgaagcttttgtgataagtcaaccctcagaaaacaccagaggatacactcaggggagaagccttatgtttgcagggagtgtgggcgaggctttagccagaactcagatctcatcaaacaccagaggacacacttggatgagaagccttatgtttgcagggagtgtgggcgaggcttttgtgacaagtcaaccctcatcatacacgagcggacgcactctggagagaagccttatgtgtgtggtgagtgtggccgaggctttagtcggaaatcactcctccttgtccaccagaggacacactcaggggagaagcattatgtctgcagggagtgtaggcgaggttttagccagaagtcaaatctcatcagacaccagaggacgcactcaaatgagaagccttatatttgcagggaatgtgggcgaggcttttgtgacaagtcaaccctcattgtacatgagaggacacactcaggagagaagccttacgtgtgcagtgagtgtggccgaggctttagccggaaatcactcctccttgtccaccagaggacacactcaggggagaagcattatgtttgtagggagtgtgggcgaggctttagtcataagtcaaatctcatcagacaccagaggacacactgacgggagaaacctgtgtatgcaggggtcatgaacaagacctgagtgaccagtcaagcctcatgttaccccagagagacacatggggagtagaccctgtgtacacagattgtgagtgaagttccagagatgtgtcagcccttatcaggcatgggagggacacgttcaggagaggagccttatgagtatagagtacgggcaactgtagccatcagtcagccttgagcatgcacaaaaggacacacttaggagagaagtttatgtgtagggactgtgggaaggctttagcaataatcaacatttaccagacatccaatgacagcctcaggggaaagcacccttgtctggggagtgttggggagcatcagtaaaagaatggacactcaggcacagagtggccctcaggaaggaggtctttgtttgtaggatgtatgggcaaagcttttgtgatcacacaccacagggagaatctgcatgtggggacactgtggagctctgcccagatgaccttttcaggggtaacaccccagctgcttgagagaacagtgttgctgctggcagagatgcattccagagatgcactccgctctggaactcactctcagccacagggagctgcatgcaccacaggggcaatgcacctttgcaggggtaccttctggccccaacccttgactcaacggggacaactccagaaggtcattccagatccagagatccccatcgaactgaaggatcactgggttgcagacacattgcaggtcagcttcttcctctgcccagtcctgccctcactccccagtgaatcctcaattttctgtctcgttgtctgtccagataattgattctaagacatgttaggtatataaggagtgtagataaggcttcagccatgagtcaccccgcagtaagccccagagtatattgaatagaaattctgcatgtgtggggagaatggacaaggacttaggaaaaagtcctcatcaaagaacagcttttttgggacaagctttacatgggtggggagggaaaatgtgaaacacattagcaataagttaaacctcatcttgtactaaaggaggacacactcagggagaagacctctgtgggcagggcttgtgggtggagcttcatcccgatgtcactcctcaactgacttaggaggacagtcttgctaccccaagtcactacctcactcacctctgagggattttcaggaaatgtcttgactcccccatgtactctgtatgtgagcgaagatggcagtaactgttaaataagcattcttttctacttcttggaatcagatgaaataaaaaagcaggctttatttaagtaatc

SEQ ID NO: 202221 - DNA, 533 bp, Homo sapiens
  Payload ID: 19890
  Gene Name: zinc finger protein 345
  ENST ID: ENST00000331800
  CDS Start-End: 195-533
acggcattgaccctaccgttgtctgtgatgcccggattaagcaggatgccctagacttctctgaccttcctctccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatact

SEQ ID NO: 202222 - DNA, 3527 bp, Homo sapiens
  Payload ID: 19890
  Gene Name: zinc finger protein 345
  Uniprot ID: Q14585
  ENST ID: ENST00000529555
  CDS Start-End: 789-2255
tttaattgtgaccgggttgggcactgtgtttgcgagtgtgaggttcctggaccgcggttgtgactgtatgtccccttggggtgtgtgtgtgtgtgtttactaccatttgccgaactgtgtgtagtatgccttaattttgaggtttgtggctgcttccgtgtgtgtgtgtgcgcgcgcgttggtgatattgttgatggagggtgcgtgtgaatttgttgtcattgtgaccccaaggtgtatgtcactgggaatttgagagatgcccacggactctgtggttgtgtccgtgtctacccccgtggtgtgtatgagtgtgtgattgtgtgttgtgtttaggtttggggtgcctgtgacgtttatgtccctgcggtgtgagtgagtttgtgtgactatgtgtccgtatagccaatgtaggtatggggagtctttgtctttgtgacttcagccattggagacccctgtgagctcagggacaggttctgcccagaacggcattgaccctaccgttgtctgtgatgcccggattaagcaggatgccctagacttctctgaccttcctctgtaggtgatgggcagtaggggctgagcaaagataacttctgacatagtcaaaccaactccctctcagaagaacctgatgtttcctgactgctttctccttcctcagccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttattcgacatcagatcattcacagtggtgagaagccttatgagtgtaaggaatgtgggaagtcctttagttttgaatcagcccttattcggcatcacagaattcacacaggtgagaaaccttatgaatgtatagattgtggtaaagcctttggcagtggttcaaaccttactcaacatcggcggattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatcctactatattttttcaatggtcttttttttttgtattatacagaattactgattcattgaaaaattattttatttattgcaagtctaaatttatcctttttttctttcctgattatcctaacaccatttattcaataaccttgtccattttcatattttttttattgactatttgatggtaagttacatttttattcacataaagcttggatatcaggtcagtgtttttttgtttttgtttttgtttttgtttttttgagatggagtctcactgtcaccaggctggagtgcagtggtgcaatctcggttcactgcaacctccacctcccgagttcaagtgattttcctgcctcagctccccagtagctgggactacaggcgcccgccaccacgcccagctaattttttgtattttcattagagatggggtttcaccacgttggccaggatggtctcgatctcttgacctcgtgatccatctgcctcggcctcccaacgtgctggaattacaggcatgagccaccatgcctggcccagtgtttgttttttaaatttatatatatgtatctatgtctcatcctgtttatggtcaataactgttacttttaagtatcctttaatacctgtaccttttgttttagaagattgtttactttccttttataaaattatactctccattttagcaaaacagctttccctcatcataatgtagataaaaagaaaaaaaggatatggttacctgtaatcttaccaatcatagataatcactgtcaaacttttggagcaaatcctttaatactatctctcattgttttggaaacaaggtgtgattatgctatactataaccagcccttaatattttttgtctgtaaatatgttgttaccattttattggctttatagtattcacctgtctttatcaaaccccaattttgtcaaatattaaaaattttgccattataaa

SEQ ID NO: 202223 - DNA, 1971 bp, Homo sapiens
  Payload ID: 19890
  Gene Name: zinc finger protein 345
  Uniprot ID: Q14585
  ENST ID: ENST00000420450
  CDS Start-End: 201-1667
ggccttggggctttgtgagatagctagggtcgacttgtgtggattctagtagaacggagctgaccctatccgaacaggcccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttattcgacatcagatcattcacagtggtgagaagccttatgagtgtaaggaatgtgggaagtcctttagttttgaatcagcccttattcggcatcacagaattcacacaggtgagaaaccttatgaatgtatagattgtggtaaagcctttggcagtggttcaaaccttactcaacatcggcggattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatc

SEQ ID NO: 202224 - DNA, 581 bp, Homo sapiens
  Payload ID: 19890
  Gene Name: zinc finger protein 345
  ENST ID: ENST00000532141
  CDS Start-End: 358-581
atttgggcaagcggccttggggctttgtgagatagctagggtcgacttgtgtggattctagtagaacggagctgaccctatccgaacaggcccctgccctgcttggatagaggcctccgaacaggagtaaagaatggctgttgaacatccacaaggcacctgcaagacctctaacttcaccctggagttgagcagaaacatggcttgccttttccctcagatcagtcttggactccagacaaagggttggaactttgagccaataagcaggttactggtaacagtgcctgaggaaagacaaagctatgggtactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatc

SEQ ID NO: 202225 - DNA, 3120 bp, Homo sapiens
  Payload ID: 19890
  Gene Name: zinc finger protein 345
  Uniprot ID: Q14585
  ENST ID: ENST00000589046
  CDS Start-End: 379-1845
gggtgaaagaaagcttgccccagaggacttaaacaggcaagaaggacttggttaaagactattgcaatagtcaacttccaatacaacagcagctggagatttatagctaacgggctgggtgaaggagttaaaggatgctaaattactaagaggaagtgatgggcagtaggggctgagcaaagataacttctgacatagtcaaaccaactccctctcagaagaacctgatgtttcctgactgctttctccttcctcagccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttattcgacatcagatcattcacagtggtgagaagccttatgagtgtaaggaatgtgggaagtcctttagttttgaatcagcccttattcggcatcacagaattcacacaggtgagaaaccttatgaatgtatagattgtggtaaagcctttggcagtggttcaaaccttactcaacatcggcggattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatcctactatattttttcaatggtcttttttttttgtattatacagaattactgattcattgaaaaattattttatttattgcaagtctaaatttatcctttttttctttcctgattatcctaacaccatttattcaataaccttgtccattttcatattttttttattgactatttgatggtaagttacatttttattcacataaagcttggatatcaggtcagtgtttttttgtttttgtttttgtttttgtttttttgagatggagtctcactgtcaccaggctggagtgcagtggtgcaatctcggttcactgcaacctccacctcccgagttcaagtgattttcctgcctcagctccccagtagctgggactacaggcgcccgccaccacgcccagctaattttttgtattttcattagagatggggtttcaccacgttggccaggatggtctcgatctcttgacctcgtgatccatctgcctcggcctcccaacgtgctggaattacaggcatgagccaccatgcctggcccagtgtttgttttttaaatttatatatatgtatctatgtctcatcctgtttatggtcaataactgttacttttaagtatcctttaatacctgtaccttttgttttagaagattgtttactttccttttataaaattatactctccattttagcaaaacagctttccctcatcataatgtagataaaaagaaaaaaaggatatggttacctgtaatcttaccaatcatagataatcactgtcaaacttttggagcaaatcctttaatactatctctcattgttttggaaacaaggtgtgattatgctatactataaccagcccttaatattttttgtctgtaaatatgttgttaccattttattggctttatagtattcacctgtctttatcaaaccccaattttgtcaaatattaaaaattttgccattataaacac

SEQ ID NO: 202226 - DNA, 651 bp, Homo sapiens
  Payload ID: 19890
  Gene Name: zinc finger protein 345
  ENST ID: ENST00000585396
  CDS Start-End: 98-651
agcaacacaagtagactaaggcatcaagttttaccacttaagattaaggtgactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttattcgacatcagatcattcacagtggtgagaagccttatgagtgtaaggaatgtgggaagtcctttagttt

SEQ ID NO: 202227 - DNA, 564 bp, Homo sapiens
  Payload ID: 19890
  Gene Name: zinc finger protein 345
  ENST ID: ENST00000586646
  CDS Start-End: 282-564
gaccctaccgttgtctgtgatgcccggattaagcaggatgccctagacttctctgaccttcctctccctgccctgcttggatagaggcctccgaacaggagtaaagaatggctgttgaacatccacaaggcacctgcaagggaggaaatttggacacacagagagatgccaaggatacacacagaggaaagaccatgtgagtgcatagcaagaaagtgaccatctgcaagccaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaat

SEQ ID NO: 202228 - DNA, 458 bp, Homo sapiens
  Payload ID: 19890
  Gene Name: zinc finger protein 345
  ENST ID: ENST00000526123
  CDS Start-End: 196-423
tggggctttgtgagatagctagggtcgacttgtgtggattctagtagaacggagctgaccctatccgaacaggcccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagagatcccccacaggcgctgcctgagacccagctctgtgtctcctcgtcgtacagcttgtggagctccgactgcaaggccatcagcatgcccaggcaggggttaagctggagggccatggaggaggacaggccagcaggatgccgcttctgctccagggcatgcaccatgcgtgagatattctaattatatacacgttcataaacatatgctcacatgca

SEQ ID NO: 202229 - DNA, 571 bp, Homo sapiens
  Payload ID: 19890
  Gene Name: zinc finger protein 345
  ENST ID: ENST00000586933
  CDS Start-End: 413-571
ggatttgggcaagcggccttggggctttgtgagatagctagggtcgacttgtgtggattctagtagaacggagctgaccctatccgaacaggcccctgccctgcttggatagaggcctccgaacaggagtaaagaatggctgttgaacatccacaaggcacctgcaagctcctcttcaccttctgctagtggaagcagcctgaaaccttcatcagaagaagctgttggtgccatgcatcttgtacagcctgcagaactgtgagccaaataaacctcttttctttataagttacccactcttagatatgtcttcatagcaacacaagtagactaaggcatcaagttttaccacttaagattaaggtgactatgaatcaaagttgagaccaagaaattatttctgaaaaaggatatggaaaaccttacaaaacacagcattgagtgttcaagtttcagagatcccccacaggcgctgcctgagacccagctctgtgtctcctcgtcgtacagcttgtggagctccgactgcaaggccatcagcatgcccaggcaggggttaagctggagggcc

SEQ ID NO: 202230 - DNA, 3103 bp, Homo sapiens
  Payload ID: 19890
  Gene Name: zinc finger protein 345
  Uniprot ID: Q14585
  ENST ID: ENST00000614069
  CDS Start-End: 360-1826
ggatttgggcaagcggccttggggctttgtgagatagctagggtcgacttgtgtggattctagtagaacggagctgaccctatccgaacaggcccctgccctgcttggatagaggcctccgaacaggagtaaagaatggctgttgaacatccacaaggcacctgcaagacctctaacttcaccctggagttgagcagaaacatggcttgccttttccctcagatcagtcttggactccagacaaagggttggaactttgagccaataagcaggttactggtaacagtgcctgaggaaagacaaagctatgggtactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttattcgacatcagatcattcacagtggtgagaagccttatgagtgtaaggaatgtgggaagtcctttagttttgaatcagcccttattcggcatcacagaattcacacaggtgagaaaccttatgaatgtatagattgtggtaaagcctttggcagtggttcaaaccttactcaacatcggcggattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatcctactatattttttcaatggtcttttttttttgtattatacagaattactgattcattgaaaaattattttatttattgcaagtctaaatttatcctttttttctttcctgattatcctaacaccatttattcaataaccttgtccattttcatattttttttattgactatttgatggtaagttacatttttattcacataaagcttggatatcaggtcagtgtttttttgtttttgtttttgtttttgtttttttgagatggagtctcactgtcaccaggctggagtgcagtggtgcaatctcggttcactgcaacctccacctcccgagttcaagtgattttcctgcctcagctccccagtagctgggactacaggcgcccgccaccacgcccagctaattttttgtattttcattagagatggggtttcaccacgttggccaggatggtctcgatctcttgacctcgtgatccatctgcctcggcctcccaacgtgctggaattacaggcatgagccaccatgcctggcccagtgtttgttttttaaatttatatatatgtatctatgtctcatcctgtttatggtcaataactgttacttttaagtatcctttaatacctgtaccttttgttttagaagattgtttactttccttttataaaattatactctccattttagcaaaacagctttccctcatcataatgtagataaaaagaaaaaaaggatatggttacctgtaatcttaccaatcatagataatcactgtcaaacttttggagcaaatcctttaatactatctctcattgttttggaaacaaggtgtgattatgctatactataaccagcccttaatattttttgtctgtaaatatgttgttaccattttattggctttatagtattcacctgtctttatcaaaccccaattttgtcaaatattaaaaattttgccattataaacactt

SEQ ID NO: 202231 - DNA, 2938 bp, Homo sapiens
  Payload ID: 19890
  Gene Name: zinc finger protein 345
  Uniprot ID: Q14585
  ENST ID: ENST00000612719
  CDS Start-End: 195-1661
acggcattgaccctaccgttgtctgtgatgcccggattaagcaggatgccctagacttctctgaccttcctctccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttattcgacatcagatcattcacagtggtgagaagccttatgagtgtaaggaatgtgggaagtcctttagttttgaatcagcccttattcggcatcacagaattcacacaggtgagaaaccttatgaatgtatagattgtggtaaagcctttggcagtggttcaaaccttactcaacatcggcggattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatcctactatattttttcaatggtcttttttttttgtattatacagaattactgattcattgaaaaattattttatttattgcaagtctaaatttatcctttttttctttcctgattatcctaacaccatttattcaataaccttgtccattttcatattttttttattgactatttgatggtaagttacatttttattcacataaagcttggatatcaggtcagtgtttttttgtttttgtttttgtttttgtttttttgagatggagtctcactgtcaccaggctggagtgcagtggtgcaatctcggttcactgcaacctccacctcccgagttcaagtgattttcctgcctcagctccccagtagctgggactacaggcgcccgccaccacgcccagctaattttttgtattttcattagagatggggtttcaccacgttggccaggatggtctcgatctcttgacctcgtgatccatctgcctcggcctcccaacgtgctggaattacaggcatgagccaccatgcctggcccagtgtttgttttttaaatttatatatatgtatctatgtctcatcctgtttatggtcaataactgttacttttaagtatcctttaatacctgtaccttttgttttagaagattgtttactttccttttataaaattatactctccattttagcaaaacagctttccctcatcataatgtagataaaaagaaaaaaaggatatggttacctgtaatcttaccaatcatagataatcactgtcaaacttttggagcaaatcctttaatactatctctcattgttttggaaacaaggtgtgattatgctatactataaccagcccttaatattttttgtctgtaaatatgttgttaccattttattggctttatagtattcacctgtctttatcaaaccccaattttgtcaaatattaaaaattttgccattataaacactt

SEQ ID NO: 202232 - DNA, 2314 bp, Homo sapiens
  Payload ID: 19891
  Gene Name: zinc finger protein 346
  Uniprot ID: Q9UL40
  ENST ID: ENST00000358149
  CDS Start-End: 44-928
aggcgcctgagaggctctctaccggtgagggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagtggagcacatgatccagaagaaccaatgtctcttcaccaacacccagtgtaaggtttgctgcgccttgcttatttctgagtcccagaagctggcacattaccagagcaaaaaacatgccaacaaagtgaagagatacctagcaatccatggaatggagacattaaagggggaaacgaagaagctagactcagatcagaagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccgggtgatttctgggtcccagggaaagaaagagagagctgatgcaggtttctacagtgaggaacaggcgtttcccaggccccacacccagatttctctatctttgctgtgttttatggcctgggactgagtccacacggatagatttttccttgtaaccttgagacgagaattccaaggagtgtcaccatcagaggcttctcttcattgtgtcaaagaagcccctagctgctctcgtggcctccttcccccactccctatcccttcacctgtgaaatgcctttgctttgcatattgtgtgtggatgtgtgtgtgtgtgtgtgtgtgtttgtgtgtatgtgtgtgcttctgtgtgtgcctaatgctctgtctcttggtcactgaagcatccaaataaagaatttccctcatgggccagactacaacttaaca

SEQ ID NO: 202233 - DNA, 1575 bp, Homo sapiens
  Payload ID: 19891
  Gene Name: zinc finger protein 346
  ENST ID: ENST00000512315
  CDS Start-End: 44-400
aggcgcctgagaggctctctaccggtgagggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagagctaggggtggccgtgtcacagtctggccaaggaaatgaaattgggagttgctgtgtggaaactcaactctctggaacttcttccttcctcctgcctctgcacaaatgtgacggcagcagctgaagccaacatcttgcgaccatgagagaaaaacctggagaacggacgagtcctcaaccctgacttcagaccaacctacacccacctctggacgtggggctaagtgagagatggatacactgtttcatttaggccctgctcacttaggtttctgttattcacaccccaacgaaaccctccatggtccagggcaccgggcaaagtacagaagggcacgagtttacttcccgcttccctggagaccaccaaccctctcacccttccagcccagcctctgccacttcccagctgtcggtcctcctccaaacagacgtgcatgccaacacccggtgggtgtgaggcttgtaggcccaagtctagagaggctgagtctggcaaagcctgaaagcccctgtcctagcaagccaggccacaggtctagagtatccgagaccagtgaataaggggacggggggtgctactgaggctgtgagaagccccaggaccagcccagggtagttagaactgagtgaggttagccgggactaacctcactcagatccctcctccccagttcccctccatccactttggtttggaagcctccccagagctctcccaggctgtcatcagctctaaactctctgcctccacaaaaatgccctgggcaacctgtaactcacagccctgctgtcttcagagtataaactggagacagatgtacccagaattgaggacgggtgggaaatgaggagaaatgaaggctgaggaggggtcattctcacagtccctccctttcggtcacaggagggtgttgcccatgcttttgggtgggtcccaggcccatagctgcaaatattcatattggctactcttcagtgagcaaggggtatatgccaggcactggcattgtgcttgacatacatcatcatactgagtcctcacggaagatgtattattcccatttcacagaagatgaaactgaggcttgaggttaagtgatttgtccgtgaccacaaagagttttcgggactcaaacccagatctgtcactgggcaaggtggctcacaccta

SEQ ID NO: 202234 - DNA, 1191 bp, Homo sapiens
  Payload ID: 19891
  Gene Name: zinc finger protein 346
  Uniprot ID: Q9UL40
  ENST ID: ENST00000503425
  CDS Start-End: 36-824
gagaggctctctaccggtgagggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagtggagcacatgatccagaagaaccaatgtctcttcaccaacacccagtgtaaggtttgctgcgccttgcttatttctgagtcccagaagctggcacattaccagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagca

SEQ ID NO: 202235 - DNA, 1622 bp, Homo sapiens
  Payload ID: 19891
  Gene Name: zinc finger protein 346
  ENST ID: ENST00000508155
  CDS Start-End: 24-419
accggtgagggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagtggagcacatgatccagaagaaccaatgtctcttcaccaacacccagtgtaaggtttgctgcgccttgcttatttctgagtcccagaagctggcacattaccagagcaaaaaacatgccaacaaagtgaagagatacctagcaatccatggaatggagacattaaagggggaaacgaagaagctagactcagatcagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggt

SEQ ID NO: 202236 - DNA, 1276 bp, Homo sapiens
  Payload ID: 19891
  Gene Name: zinc finger protein 346
  ENST ID: ENST00000506693
  CDS Start-End: 44-634
aggcgcctgagaggctctctaccggtgagggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagctctgtcaaaacgccttacaaatcctttccttgtggcctccaccttagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaat

SEQ ID NO: 202237 - DNA, 977 bp, Homo sapiens
  Payload ID: 19891
  Gene Name: zinc finger protein 346
  ENST ID: ENST00000513587
  CDS Start-End: 5-412
gaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagtggagcacatgatccagaagaaccaatgtctcttcaccaacacccagtgtaaggtttgctgcgccttgcttatttctgagtcccagaagctggcacattaccagagcaaaaaacatgccaacaaagtgaagagatacctagcaatccatggaatggagacattaaagggggaaacgaagaagctagactcagatcagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgcc

SEQ ID NO: 202238 - DNA, 2774 bp, Homo sapiens
  Payload ID: 19891
  Gene Name: zinc finger protein 346
  Uniprot ID: Q9UL40
  ENST ID: ENST00000503039
  CDS Start-End: 5-964
gaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagcgcagtttttcccacattcgaggactgtcatccctatactcgtcctgtcggagacctacagtctttgccatcccgtggagcacatgatccagaagaaccaatgtctcttcaccaacacccagtgtaaggtttgctgcgccttgcttatttctgagtcccagaagctggcacattaccagagcaaaaaacatgccaacaaagtgaagagatacctagcaatccatggaatggagacattaaagggggaaacgaagaagctagactcagatcagaagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagagctaggggtggccgtgtcacagtctggccaaggaaatgaaattgggagttgctgtgtggaaactcaactctctggaacttcttccttcctcctgcctctgcacaaatgtgacggcagcagctgaagccaacatcttgcgaccatgagagaaaaacctggagaacggacgagtcctcaaccctgacttcagaccaacctacacccacctctggacgtggggctaagtgagagatggatacactgtttcatttaggccctgctcacttaggtttctgttattcacaccccaacgaaaccctccatggtccagggcaccgggcaaagtacagaagggcacgagtttacttcccgcttccctggagaccaccaaccctctcacccttccagcccagcctctgccacttcccagctgtcggtcctcctccaaacagacgtgcatgccaacacccggtgggtgtgaggcttgtaggcccaagtctagagaggctgagtctggcaaagcctgaaagcccctgtcctagcaagccaggccacaggtctagagtatccgagaccagtgaataaggggacggggggtgctactgaggctgtgagaagccccaggaccagcccagggtagttagaactgagtgaggttagccgggactaacctcactcagatccctcctccccagttcccctccatccactttggtttggaagcctccccagagctctcccaggctgtcatcagctctaaactctctgcctccacaaaaatgccctgggcaacctgtaactcacagccctgctgtcttcagagtataaactggagacagatgtacccagaattgaggacgggtgggaaatgaggagaaatgaaggctgaggaggggtcattctcacagtccctccctttcggtcacaggagggtgttgcccatgcttttgggtgggtcccaggcccatagctgcaaatattcatattggctactcttcagtgagcaaggggtatatgccaggcactggcattgtgcttgacatacatcatcatactgagtcctcacggaagatgtattattcccatttcacagaagatgaaactgaggcttgaggttaagtgatttgtccgtgaccacaaagagttttcgggactcaaacccagatctgtcactgggcaaggtggctcacacctataatcccagccctttgggagactgaggccagcagatctcctgtggccaggagttcaagcctggccaacaatggcaaaaccccgtctctaccaaaaatacaaaaattagctgggcgtggtggcacacacccgtaatcccagctactcaggtggctgaggcaggagaatcacttgaacccaggaggtggtggttgcagtgagcctagatcgtgccactgcattccagcctgagcgacagagtaagactctgtctccaaaaaaaacccagatctgtccgactctgacacccaacctttaatcactcactttctgtcaatgtcacctccgttttgaccagccaagctagacctccctggagcctgtggagaagccaaggtagaaaagggttggaaaagaatgataaaataggccaggtgcggtggctcaagcctgtactcccagcacttttggaggccgagacaggcagattgcttgagcccaggagttcaagaccagcctgggcaacataatgagaccctgtttcaacttaaaaaaaagaaatggtaatgaacaattgtcaattctgagcagctgggtatggtatgaccctgtgtactttttctgtattttaaaatgttctcaaaataaaacttgttt

SEQ ID NO: 202239 - DNA, 2306 bp, Homo sapiens
  Payload ID: 19891
  Gene Name: zinc finger protein 346
  ENST ID: ENST00000511834
  CDS Start-End: 8-940
ggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagtggagcacatgatccagaagaaccaatgtctcttcaccaacacccagtgtaaggtttgctgcgccttgcttatttctgagtcccagaagctggcacattaccagagcaaaaaacatgccaacaaagtgaagagatacctagcaatccatggaatggagacattaaagggggaaacgaagaagctagactcagatcagaagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaagctctgtcaaaacgccttacaaatcctttccttgtggcctccaccttagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccgggtgatttctgggtcccagggaaagaaagagagagctgatgcaggtttctacagtgaggaacaggcgtttcccaggccccacacccagatttctctatctttgctgtgttttatggcctgggactgagtccacacggatagatttttccttgtaaccttgagacgagaattccaaggagtgtcaccatcagaggcttctcttcattgtgtcaaagaagcccctagctgctctcgtggcctccttcccccactccctatcccttcacctgtgaaatgcctttgctttgcatattgtgtgtggatgtgtgtgtgtgtgtgtgtgtgtttgtgtgtatgtgtgtgcttctgtgtgtgcctaatgctctgtctcttggtcactgaagcatccaaataaagaatttccctcatg

SEQ ID NO: 202240 - DNA, 7960 bp, Homo sapiens
  Payload ID: 19892
  Gene Name: zinc finger protein 347
  Uniprot ID: Q96SE7
  ENST ID: ENST00000334197
  CDS Start-End: 70-2589
gggtgcgggtgacgccgccgagcgaagaacccttgaagaagaggaagaggaaagaaagacaagtcaggcatggctctcacccagggacaggtgacattcagggatgtggctatagaattctctcaggaggagtggacatgcctggaccccgctcagaggactttgtacagggacgtgatgttggagaattataggaacctggcctccctgggaatctcttgttttgacctcagtattatctctatgttggagcaagggaaggagcctttcactttggagagccaagtacaaatagcaggaaacccagatggatgggaatggatcaaagctgtgatcacagctctctcttccgaatttgtaatgaaagatttactacacaaagggaagagtaatacaggagaagtattccaaacagtgatgttggaaagacaggaaagccaagacattgaaggatgttccttcagggaagtccagaaaaatacacatggccttgagtatcaatgcagagatgctgaaggaaattacaaaggagtgcttttgacccaagaaggcaatctcactcatggaagagatgaacatgataaaagagatgcaagaaacaagcttattaaaaatcagcttggattaagccttcagtcacatctgcctgaactgcagctttttcaatatgaagggaaaatttatgaatgtaatcaggttgagaagtctttcaacaataattcctcagtttcaccacctcaacaaatgccttataatgtcaaaacccacatttctaagaaatatctcaaagattttatctcttctttattactcacacaggggcaaaaagcaaataattggggaagcccttacaaatctaatggatgtggcatggtctttcctcaaaattcacaccttgcaagtcatcagagaagtcatactaaagagaaaccttacaaatgttatgagtgtggcaaagcctttagaacacgttcaaacctaactacccatcaggtgatccatactggcgaaaaacgttacaaatgtaatgagtgtggtaaggtctttagtcgaaattcacaactctcacaacatcagaaaattcacactggagagaaaccttataaatgtaacgaatgtggcaaggtcttcactcagaattcacaccttgtaagacatcgaggaattcatactggagagaaaccttacaagtgtaatgagtgtgggaaagcctttagagctcgttcaagcttagctatccatcaggcaacccacagtggagaaaaaccttacaaatgtaatgaatgtggcaaggtcttcactcaaaattcacaccttacaaatcactggagaattcacactggagagaaaccttacaagtgtaatgagtgcggcaaagcctttggtgttcgttcaagcctagctattcatctggtaattcacaccggagaaaagccttacaaatgtcatgaatgcggcaaggtctttaggcgtaattcacaccttgcaaggcatcagctaattcatactggagagaaaccttataagtgtaatgagtgtggcaaagcctttagagcacattcaaacctaactacccatcaggtcatccatactggagaaaagccttacaaatgtaatgaatgtggcaaggtcttcactcaaaattcacaccttgcaaatcatcaaagaattcatactggagtgaagccttatatgtgtaatgagtgcggcaaagccttcagtgtgtattcaagcctaactacccatcaggtcatccatactggagaaaaaccttacaaatgtaatgagtgtggcaaggtcttcactcagaattcacaccttgcaagacatcggggaattcatactggagagaaaccttataaatgtaatgaatgtggcaaggtctttaggcataattcatacctttcaaggcatcagcgaattcatactggagagaaaccttacaagtataatgagtatggcaaagcctttagtgaacattcaaacctaactacccatcaggtcatccatactggtgaaaaaccttacaaatgtaatgagtgtggcaaggtcttcactcagaattcacaccttgcaagacatcggagagttcatactggaggtaaaccttaccagtgtaatgaatgtggcaaagcctttagtcaaacatcaaagcttgcaaggcatcagagagttcatactggagagaaaccatatgagtgtaatcagtgtgggaaagcctttagtgtccgttcaagcctaactacccatcaggcaatccatactggaaaaaaaccttacaaatgcaatgagtgtgggaaggtcttcactcagaattcacaccttgcaagacatcggggaattcatactggagagaaaccttacaagtgtaatgagtgtggcaaagcctttagtcaaacttcaaaacttgcaaggcatcagagaattcataccggagagaaaccatatgagtgtgggaaaccctttagtatctgttcaagcctaactacccatcagacaatccatactggtgggaaaccttacaaatgtaacgtgtggaaagttctaaagtcagagttcaaaccttgcaagccatcacagaattcatagtggagagaaaccttacaaatgaaggtggtaacttttgcagttagaattcattcctttgacaacgtcagagaatttatgcctgagagattccttgaaaatgcaatgactggctgggtgcagtggctcatgcctgtaatcccaacactttgggagtccgaggcaggtggatcacctgaggtcaggagttcaagaccagcctgaccaacatggcgaaaccccatttctactaaaagtacacaattagctaggcctggtggcgtgcgcctgtaatcccagctatataggaggctgaggcaggagaatcacttgaacccaggaggcggaggttgcagtgagccaagatcgtgccaatgcactccatcctgggcaaaaagagcaaaactccatcttaaaggaaaaaaaaaaaatgcaatgactgtggcaaactcctcatgagttcaagtattaatagacatccaagagtccataataatgagaaatcacataaatgtactgtgtgtgacagaggctttattcaggcctcacagctttgcaggcattaaaatctacgtatttgatggaaccacacaaatgtaatgtgtaagagcatcctgaagctcttactctaagactgtaactgtaggtgaggattcatacaaagagtgactcagtctctagttctttgattcacttttaaaatgataaactgcacaataattacacgttccaatatggtaaaacttaagacattatatatttcaaaggtcaaaggacatttggaaatggctacttaccttcaggttataaaatcttttattccattgtttgaggtttctcaaaaaggctactgtttgtgactttcaacctgaactatggatctgtggctattttgcatccttaagcacctttcgtggtgcctatctgggaaagaaccacagtatggaaaggcttacttcattacatgaggatcatttttatccatgtttattgaagaaggaggactctgccttgtaaaattaaatattctctcaattgagagaccatggttttggggcagaaaataatgtaaaactatgatatcaatcatcatactgattgtgttcagggtgcttttctgagagaaagacaccatgggttttagggaagtaaggctctacctgcattgagcaggccaagacctcaggacactggaatttttatgagaggagagtaataagttattagtgactgattatgtgatgggaatagtgcaggggaaatggttgccactttctctactgaatggcaatagctgttttatagcagagattgatgaaaaataggcttatttttgaaattgaagaggtaacagttattagagtggagagcttggtcagaaaaaccagaataccatggttttttttgttttgttttgtttttagtagaattcacactaattgctggaattacattttgctacagttttattaagaatgtgtcacagacataatgttttgctaaaaaaaattcaacgttttcttataactataaacaaatcacattctttgtaccaacatcattttatcctacctcagtaggatacttcatagcagataataacaatacactcagtcttttaggttggaggatgtagaacaattttttttttctttgtggaatcaacatacaattttgggaaaatgtaatcatactctgcacttgaattattctctctacactctgccttagaatatttatatggatataatgaaaatcccatagaaagtgcagttttcatactcttacactctgaaagctgccacagtgttggtgaatatataccatattatatttttacatgcttgtgtgctaaataactatggcatgcatctttatttacatgaagtgaaaatacaaatatagaaagtgtatgggctgggtgtggtggttcatgcctgtaatcctagcactttgagagcccaaggcaggggggtcacttgagtccaggagtttgaaccagccaggacaacatggcaaaaccctgtctctacaaaaaaaatagaaatattacccaggcagggtggctcatgcctgtagtcccagctcctcagggagactgaggcaggtggatcacttgagcctggaggcagaggttgcagtgagccaagatcgcgccattgcactccagcctgggtgacagagcgagaccctgtctcaaaaaaaacaattgtatgaaaaatattggctgggtgtggtggctcacacctgtaatcccagcacttagggaggccaaggcgggtggatcatggggtcagaaaatcgagaccaccctggccaacacagtgaaaccccatctctactaaaaaataccaaatatatatatattggttggatgtggtggcatgcgcctgtaatcccagctactcgggaggctgaggcaggagaatcacttgaacccaggaggtggaggttgcagtgagccgagattgccactgcactccagcctgggcgagaaagtgagactccgtctcaaaaaaaaaaattatgaaattataaatagtgcagaataacaaaaataacactaagaatgctatgctcacataatttgacaagactaatattcatgagtttcctcttaaaaatgaacatatataatggaaattttgtttttgtaggtaaactagaagtttcataaatttagccttatcatgtttttggtaatgttaatttgtcacctctccacaggaagtgtattgaactccatttacagtttggtttagatatggaaaatgaggatgctgaacaatgaagttttagggaaatgtgtattgcataatgaggctttctgtgagaagcaggattgacttcccaaactggtccaaaatggcttgagagagcagggataaataacttgcttggggtgttatggtaataacctttaataaaagggtgggttggggtgaggatcccacacgtgatttgaacttccatctagtgccaaaggagggaacacggacattatcagcttggccagatgggcagaataagaagagggagtgcagaggtataaatggtggtataagacaaaaatcacaaaatggaaactgactgtagtacaacactgaatatttactcttgcaacttctgatttctggccaggcatggccagaaattacaggctcatgcctgtaatcccagcactttgggagcccgaggcaggtggatcaccttaggtcaggagctcaagacgagcctggccaacatggtgaaaccccatctctactaaaaatacaaaaattagccaggtgtggtggcgcactcctgtagtcctagctaccagggaggctgaggcaggagaatcacttgaacccgggagacggaggttgcagtgagctgagatctcaccactgcactccagcctgggcaatagagtgagactctcaaaaaaacaaaagaaatttctaacttctttgttagggaagacctccgctttcttcataatagtagataatactcttcctttctgctgaacccatagggcccattacacaacgtcattcttgaaaatatttgtgaaatgctgtttaaattgcctaaaatatttttacagtagttcaatgcaaatgaatttgtggaaaagtttattacataatatgatcaagcaattttagccaaagggcatttttccaaaggctgtgttatattcatgtcttgttcagtttatggtattgtgtaacatattctccatagcttcttttctttttttttttctttttctttttagacgtggggtctcgctatgttggccaggttggtcttgaactcttggcctcaagcattcctcctgcctcagcttcccaaagtgctaggattacagccatgagccaatagtagtaaaatgactttttgtttttgtatatgatttttactttaaggattttttccttccatacattttaatccaaattatatgtttactgcatttcttctctgtgttactccagtgaacacttagaaaatacataaatgagggtgttgtttagaaataaaattttgtgacatgaaaatgtatgtaaaacaatggcaggtacagactaggttctctgtaaataggaaaatggagtgtccttgtaaatctttagttcaattaaagtacagggatactagatggtgaaatgaagtctcttaatatggaagttatcaaagatcagatgcttgaaaatcaagcgtgtggaggttaaccagcatctggagaagtaaatgaaaatacagttaataagagagtccccaagatattaattatcatttatgcaaaggagataatttctctcattgaatccctggaggcaattcaacttcctactgtggctggtatttcttttctgagccagaggatcttacagcaaaacatgatatttgtgcaacttttgcaatgacagctgccatttaatatactccccttagatttgtttccattttaaaaaactgatatatattctttaataagtgatttatctttgcatatatattttatatcaatcacatttagagtaagaatcacagttattaatgctttatgtgtaacaactgaatcatcagctcctgaaataagtattaatgatattctcatttcagaggtgaggaaacttaggacagataagcaaaataatcaaattaggctgggcacagtggctcatgcctgtaatcccagcactttgggaggccgaggcggggggatcacctgaggtcaggaattcgagaccagcctgatcaacatggtgaaaccccgtctctactaaaaatacaaaaattagctgggtgtgatggcgggcgcctgtaatcccagctattcgggaggctgaggcaggagaattgcttgagcctgggaggcggatgttgcagttagccgagttcccaccattgcactccagtctcagtgacagagcgggactccatctctctctctctctctctctctctttctctctctctctctctctctctctctctatatatatatatatatatatatatatatatatatatatatttagaaaatgggtagaactatgaagagacatttcactgaagcagttatactgagataaataggcacataaaaagatttccaacatcaccatccatcaaatctcagatctcagcatattctgctttaaaagactcatcttgtcacatttcagtaagaggcagaatcgagatttgaatccatgttgtctggttgcaaagacaaagcttttaatgatgatgctacagtaacaatgctagttatttttgtcctttactcaccatctatacctattttgttagtatctcttgtaatttttaaatggtttatcttcatatatcattgtgattgtggtaactttgtattaaatctatatttttatagatc

SEQ ID NO: 202241 - DNA, 4553 bp, Homo sapiens
  Payload ID: 19892
  Gene Name: zinc finger protein 347
  Uniprot ID: Q96SE7
  ENST ID: ENST00000452676
  CDS Start-End: 428-2950
tttctgcagttccggaagcggatcgtgttgggtgcgggtgacgccgccgagcgtgagtgtccctcagtatggattaaacttgcgaaccgccgtgccccgtttccgcagccagttcccgggctcgctacagacctttttttttttctttttttttttttttggtgagacggagatttactcttgttgtccaggctggagtgcaatggcgcgatttcggctcaccgcatcctccgcctcccaggttcaagcgattctcctgcctcagcctcccgagtagctgggattacaggcatgtgccaccacgcccggctaattttgtatttttagtagagacggggtttcaccgtgttgcccaggctgatctcgaactcctgacctcaggaagaacccttgaagaagaggaagaggaaagaaagacaagtcaggcatggctctcacccagggacaggtgacattcagggatgtggctatagaattctctcaggaggagtggacatgcctggaccccgctcagaggactttgtacagggacgtgatgttggagaattataggaacctggcctccctggcaggaatctcttgttttgacctcagtattatctctatgttggagcaagggaaggagcctttcactttggagagccaagtacaaatagcaggaaacccagatggatgggaatggatcaaagctgtgatcacagctctctcttccgaatttgtaatgaaagatttactacacaaagggaagagtaatacaggagaagtattccaaacagtgatgttggaaagacaggaaagccaagacattgaaggatgttccttcagggaagtccagaaaaatacacatggccttgagtatcaatgcagagatgctgaaggaaattacaaaggagtgcttttgacccaagaaggcaatctcactcatggaagagatgaacatgataaaagagatgcaagaaacaagcttattaaaaatcagcttggattaagccttcagtcacatctgcctgaactgcagctttttcaatatgaagggaaaatttatgaatgtaatcaggttgagaagtctttcaacaataattcctcagtttcaccacctcaacaaatgccttataatgtcaaaacccacatttctaagaaatatctcaaagattttatctcttctttattactcacacaggggcaaaaagcaaataattggggaagcccttacaaatctaatggatgtggcatggtctttcctcaaaattcacaccttgcaagtcatcagagaagtcatactaaagagaaaccttacaaatgttatgagtgtggcaaagcctttagaacacgttcaaacctaactacccatcaggtgatccatactggcgaaaaacgttacaaatgtaatgagtgtggtaaggtctttagtcgaaattcacaactctcacaacatcagaaaattcacactggagagaaaccttataaatgtaacgaatgtggcaaggtcttcactcagaattcacaccttgtaagacatcgaggaattcatactggagagaaaccttacaagtgtaatgagtgtgggaaagcctttagagctcgttcaagcttagctatccatcaggcaacccacagtggagaaaaaccttacaaatgtaatgaatgtggcaaggtcttcactcaaaattcacaccttacaaatcactggagaattcacactggagagaaaccttacaagtgtaatgagtgcggcaaagcctttggtgttcgttcaagcctagctattcatctggtaattcacaccggagaaaagccttacaaatgtcatgaatgcggcaaggtctttaggcgtaattcacaccttgcaaggcatcagctaattcatactggagagaaaccttataagtgtaatgagtgtggcaaagcctttagagcacattcaaacctaactacccatcaggtcatccatactggagaaaagccttacaaatgtaatgaatgtggcaaggtcttcactcaaaattcacaccttgcaaatcatcaaagaattcatactggagtgaagccttatatgtgtaatgagtgcggcaaagccttcagtgtgtattcaagcctaactacccatcaggtcatccatactggagaaaaaccttacaaatgtaatgagtgtggcaaggtcttcactcagaattcacaccttgcaagacatcggggaattcatactggagagaaaccttataaatgtaatgaatgtggcaaggtctttaggcataattcatacctttcaaggcatcagcgaattcatactggagagaaaccttacaagtataatgagtatggcaaagcctttagtgaacattcaaacctaactacccatcaggtcatccatactggtgaaaaaccttacaaatgtaatgagtgtggcaaggtcttcactcagaattcacaccttgcaagacatcggagagttcatactggaggtaaaccttaccagtgtaatgaatgtggcaaagcctttagtcaaacatcaaagcttgcaaggcatcagagagttcatactggagagaaaccatatgagtgtaatcagtgtgggaaagcctttagtgtccgttcaagcctaactacccatcaggcaatccatactggaaaaaaaccttacaaatgcaatgagtgtgggaaggtcttcactcagaattcacaccttgcaagacatcggggaattcatactggagagaaaccttacaagtgtaatgagtgtggcaaagcctttagtcaaacttcaaaacttgcaaggcatcagagaattcataccggagagaaaccatatgagtgtgggaaaccctttagtatctgttcaagcctaactacccatcagacaatccatactggtgggaaaccttacaaatgtaacgtgtggaaagttctaaagtcagagttcaaaccttgcaagccatcacagaattcatagtggagagaaaccttacaaatgaaggtggtaacttttgcagttagaattcattcctttgacaacgtcagagaatttatgcctgagagattccttgaaaatgcaatgactggctgggtgcagtggctcatgcctgtaatcccaacactttgggagtccgaggcaggtggatcacctgaggtcaggagttcaagaccagcctgaccaacatggcgaaaccccatttctactaaaagtacacaattagctaggcctggtggcgtgcgcctgtaatcccagctatataggaggctgaggcaggagaatcacttgaacccaggaggcggaggttgcagtgagccaagatcgtgccaatgcactccatcctgggcaaaaagagcaaaactccatcttaaaggaaaaaaaaaaaatgcaatgactgtggcaaactcctcatgagttcaagtattaatagacatccaagagtccataataatgagaaatcacataaatgtactgtgtgtgacagaggctttattcaggcctcacagctttgcaggcattaaaatctacgtatttgatggaaccacacaaatgtaatgtgtaagagcatcctgaagctcttactctaagactgtaactgtaggtgaggattcatacaaagagtgactcagtctctagttctttgattcacttttaaaatgataaactgcacaataattacacgttccaatatggtaaaacttaagacattatatatttcaaaggtcaaaggacatttggaaatggctacttaccttcaggttataaaatcttttattccattgtttgaggtttctcaaaaaggctactgtttgtgactttcaacctgaactatggatctgtggctattttgcatccttaagcacctttcgtggtgcctatctgggaaagaaccacagtatggaaaggcttacttcattacatgaggatcatttttatccatgtttattgaagaaggaggactctgccttgtaaaattaaatattctctcaattgagagaccatggttttggggcagaaaataatgtaaaactatgatatcaatcatcatactgattgtgttcagggtgcttttctgagagaaagacaccatgggttttagggaagtaaggctctacctgcattgagcaggccaagacctcaggacactggaatttttatgagaggagagtaataagttattagtgactgattatgtgatgggaatagtgcaggggaaatggttgccactttctctactgaatggcaatagctgttttatagcagagattgatgaaaaataggcttatttttgaaattgaagaggtaacagttattagagtggagagcttggtcagaaaaaccagaataccatggttttttttgttttgttttgtttttagtagaattcacactaattgctggaattacattttgctacagttttattaagaatgtgtcacagacataatgttttgctaaaaaaaattcaacgttttcttataactataaacaaatcacattctttgtaccaacatcattttatcctacctcagtaggatacttcatagcagataataacaatacactcagtcttttaggttgg

SEQ ID NO: 202242 - DNA, 511 bp, Homo sapiens
  Payload ID: 19892
  Gene Name: zinc finger protein 347
  ENST ID: ENST00000597183
  CDS Start-End: 136-511
ggaagcggatcgtgttgggtgcgggtgacgccgccgagcgaagaacccttgaagaagaggaagaggaaagaaagacaagtcaggcatggctctcacccagcaggaatctcttgttttgacctcagtattatctctatgttggagcaagggaaggagcctttcactttggagagccaagtacaaatagcaggaaacccagatggatgggaatggatcaaagctgtgatcacagctctctcttccgaatttgtaatgaaagatttactacacaaagggaagagtaatacaggagaagtattccaaacagtgatgttggaaagacaggaaagccaagacattgaaggatgttccttcagggaagtccagaaaaatacacatggccttgagtatcaatgcagagatgctgaaggaaattacaaaggagtgcttttgacccaagaaggcaatctcactcatggaagagatgaacatgataaaagagatgcaagaaacaagcttattaaaaatcagc

SEQ ID NO: 202243 - DNA, 567 bp, Homo sapiens
  Payload ID: 19892
  Gene Name: zinc finger protein 347
  ENST ID: ENST00000595967
  CDS Start-End: 262-567
gtgagatgtatgtcaggaaagggggatgaagaccatatgtatattttattatatcacaacttggatatcggcccacttactccagtttaatctattctgtcttctcattttatgtgaagattggagcttttccttatatccccctggtggatgtgtttttcattttagggacaggtgacattcagggatgtggctatagaattctctcaggaggagtggacatgcctggaccccgctcagaggactttgtacagggacgtgatgttggagaattataggaacctggcctccctgggaatctcttgttttgacctcagtattatctctatgttggagcaagggaaggagcctttcactttggagagccaagtacaaatagcaggaaacccagatggatgggaatggatcaaagctgtgatcacagctctctcttccgaatttgtaatgaaagatttactacacaaagggaagagtaatacaggagaagtattccaaacagtgatgttggaaagacaggaaagccaagacattgaaggatgttccttcagggaagtccagaaaaataca

SEQ ID NO: 202244 - DNA, 496 bp, Homo sapiens
  Payload ID: 19892
  Gene Name: zinc finger protein 347
  ENST ID: ENST00000601804
  CDS Start-End: 142-246
agttccggaagcggatcgtgttgggtgcgggtgacgccgccgagcgaagaacccttgaagaagaggaagaggaaagaaagacaagtcaggcatggctctcacccagcaggaatctcttgttttgacctcagtattatctctatgttggagcaagggaaggagcctttcactttggagagccaagtacaaatagcaggaaacccagatggatgggaatggatcaaagctgtgatcacagcttcctgaggccctcatcagaggcagatgctggcactgtgttttgtacagcctgcagaaccatgagccaaataaacctcttttttttttttgagacggagtttttctcttgttgcccaggctgtagcagtggcgcgatctcggctcaccgcaacctctgccctctgggttcaagcgattctcctgcctcagcctaccaagtggctgggattaccagtgcctaccaccatgcccggctaatttttttgtatttttagta

SEQ ID NO: 202245 - DNA, 2812 bp, Homo sapiens
  Payload ID: 19892
  Gene Name: zinc finger protein 347
  Uniprot ID: Q96SE7
  ENST ID: ENST00000601469
  CDS Start-End: 92-2614
agttccggaagcggatcgtgttgggtgcgggtgacgccgccgagcgaagaacccttgaagaagaggaagaggaaagaaagacaagtcaggcatggctctcacccagggacaggtgacattcagggatgtggctatagaattctctcaggaggagtggacatgcctggaccccgctcagaggactttgtacagggacgtgatgttggagaattataggaacctggcctccctggcaggaatctcttgttttgacctcagtattatctctatgttggagcaagggaaggagcctttcactttggagagccaagtacaaatagcaggaaacccagatggatgggaatggatcaaagctgtgatcacagctctctcttccgaatttgtaatgaaagatttactacacaaagggaagagtaatacaggagaagtattccaaacagtgatgttggaaagacaggaaagccaagacattgaaggatgttccttcagggaagtccagaaaaatacacatggccttgagtatcaatgcagagatgctgaaggaaattacaaaggagtgcttttgacccaagaaggcaatctcactcatggaagagatgaacatgataaaagagatgcaagaaacaagcttattaaaaatcagcttggattaagccttcagtcacatctgcctgaactgcagctttttcaatatgaagggaaaatttatgaatgtaatcaggttgagaagtctttcaacaataattcctcagtttcaccacctcaacaaatgccttataatgtcaaaacccacatttctaagaaatatctcaaagattttatctcttctttattactcacacaggggcaaaaagcaaataattggggaagcccttacaaatctaatggatgtggcatggtctttcctcaaaattcacaccttgcaagtcatcagagaagtcatactaaagagaaaccttacaaatgttatgagtgtggcaaagcctttagaacacgttcaaacctaactacccatcaggtgatccatactggcgaaaaacgttacaaatgtaatgagtgtggtaaggtctttagtcgaaattcacaactctcacaacatcagaaaattcacactggagagaaaccttataaatgtaacgaatgtggcaaggtcttcactcagaattcacaccttgtaagacatcgaggaattcatactggagagaaaccttacaagtgtaatgagtgtgggaaagcctttagagctcgttcaagcttagctatccatcaggcaacccacagtggagaaaaaccttacaaatgtaatgaatgtggcaaggtcttcactcaaaattcacaccttacaaatcactggagaattcacactggagagaaaccttacaagtgtaatgagtgcggcaaagcctttggtgttcgttcaagcctagctattcatctggtaattcacaccggagaaaagccttacaaatgtcatgaatgcggcaaggtctttaggcgtaattcacaccttgcaaggcatcagctaattcatactggagagaaaccttataagtgtaatgagtgtggcaaagcctttagagcacattcaaacctaactacccatcaggtcatccatactggagaaaagccttacaaatgtaatgaatgtggcaaggtcttcactcaaaattcacaccttgcaaatcatcaaagaattcatactggagtgaagccttatatgtgtaatgagtgcggcaaagccttcagtgtgtattcaagcctaactacccatcaggtcatccatactggagaaaaaccttacaaatgtaatgagtgtggcaaggtcttcactcagaattcacaccttgcaagacatcggggaattcatactggagagaaaccttataaatgtaatgaatgtggcaaggtctttaggcataattcatacctttcaaggcatcagcgaattcatactggagagaaaccttacaagtataatgagtatggcaaagcctttagtgaacattcaaacctaactacccatcaggtcatccatactggtgaaaaaccttacaaatgtaatgagtgtggcaaggtcttcactcagaattcacaccttgcaagacatcggagagttcatactggaggtaaaccttaccagtgtaatgaatgtggcaaagcctttagtcaaacatcaaagcttgcaaggcatcagagagttcatactggagagaaaccatatgagtgtaatcagtgtgggaaagcctttagtgtccgttcaagcctaactacccatcaggcaatccatactggaaaaaaaccttacaaatgcaatgagtgtgggaaggtcttcactcagaattcacaccttgcaagacatcggggaattcatactggagagaaaccttacaagtgtaatgagtgtggcaaagcctttagtcaaacttcaaaacttgcaaggcatcagagaattcataccggagagaaaccatatgagtgtgggaaaccctttagtatctgttcaagcctaactacccatcagacaatccatactggtgggaaaccttacaaatgtaacgtgtggaaagttctaaagtcagagttcaaaccttgcaagccatcacagaattcatagtggagagaaaccttacaaatgaaggtggtaacttttgcagttagaattcattcctttgacaacgtcagagaatttatgcctgagagattccttgaaaatgcaatgactggctgggtgcagtggctcatgcctgtaatcccaacactttgggagtccgaggcaggtggatcacctgaggtcaggagttcaagaccagcc

SEQ ID NO: 202246 - DNA, 495 bp, Homo sapiens
  Payload ID: 19892
  Gene Name: zinc finger protein 347
  ENST ID: ENST00000599096
  CDS Start-End: 392-495
gtgtccctcagtatggattaaacttgcgaaccgccgtgccccgtttccgcagccagttcccgggctcgctacagacctttttttttttctttttttttttttttggtgagacggagatttactcttgttgtccaggctggagtgcaatggcgcgatttcggctcaccgcatcctccgcctcccaggttcaagcgattctcctgcctcagcctcccgagtagctgggattacaggcatgtgccaccacgcccggctaattttgtatttttagtagagacggggtttcaccgtgttgcccaggctgatctcgaactcctgacctcaggcactttcctgttacctaaggaagaacccttgaagaagaggaagaggaaagaaagacaagtcaggcatggctctcacccagggacaggtgacattcagggatgtggctatagaattctctcaggaggagtggacatgcctggaccccgctcagaggactttgtacaggga

SEQ ID NO: 202247 - DNA, 2503 bp, Homo sapiens
  Payload ID: 19893
  Gene Name: zinc finger protein 35
  ENST ID: ENST00000296092
  CDS Start-End: 221-532
attgttctcgtgccggtagaagctgaagtaccggtcagccagcctcctgctgcagagccagtgaactcaggtcgggcttctcagctgcgcacataggcagtactcatcttggccctgggaagaaactcaagaagaagcttttgaaacataaagcttggatggggtttgacctctgcagggcagcgcccagctataggagttcccctgctgagcagagaagatgactgcagaattgagagaagccatggccctagccccatggggcccagtgaaggtgaaaaaggaggaggaagaagaagaaaacttcccaggtcaggcatccagccaacaagtgcactccgagaacatcaaagtctgggccccagtgcagggtcttcagacaggccttgatggatcagaagaggaagaaaaggtgctgaaaccaagaacctacagttactggttccaaaaactgagatatgtgaggaagctgaaaaacccctcatcatatcagaaagaatccagaaagctgatcctcaaggacctgagttaggagaagcttgtgaaaagggaaacatgttaaagaggcagagaataaagagagaaaagaaagatttcagacaagtgatagtgaatgactgtcacttacctgaaagcttcaaagaagaggaaaaccagaaatgtaagaaatctggaggaaaatatagccttaattctggcgctgttaaaaatccaaaaacccagcttggacaaaagccttttacgtgtagcgtgtgtgggaaaggatttagtcagagtgcaaacctcgttgtgcatcagcgaatccacactggagagaaaccctttgaatgtcatgagtgtgggaaggccttcattcagagtgcaaacctcgttgtgcatcagagaatccacactggacagaaaccttatgtttgctcaaaatgtgggaaagccttcactcagagttcaaatctgactgtacatcaaaaaatccactccttagaaaaaacttttaagtgcaatgaatgtgagaaagcctttagttacagctcacaacttgctcggcaccagaaagtccacattacggaaaaatgctatgaatgtaatgaatgtgggaaaacatttactaggagctcaaacctcattgtccaccagaggatccacactggggagaagccctttgcctgtaacgactgtggcaaagcctttacccagagtgcaaatcttattgtacatcagcgaagccatactggtgagaagccatatgagtgtaaagagtgtgggaaagcctttagttgtttttcacaccttattgtgcaccagagaattcacactgcagagaaaccttacgactgcagcgaatgtgggaaagccttcagtcagctctcttgccttattgtccaccagagaattcacagtggagatcttccttacgtgtgtaatgaatgtgggaaggccttcacatgtagctcatacctacttattcatcagagaattcataatggagaaaaaccttacacatgtaatgagtgtgggaaggccttcagacagaggtcgagcctcaccgtgcaccagagaacccacactggggagaagccctatgaatgtgagaagtgtggtgcagctttcatttccaactcacacctcatgcgacaccatagaacccatcttgttgaataacaagtaaggaagaggaagacctccagcattggtcataaccttctgcctccctaatgagacacctctttgctgttttcttcctcctctataaaagtgagggctgtgtccttaaaagttatagttttcaggaatgcagcagaagacacaagaaaagcatttcagaggctaatttaaaacaaaaagtaagcacctaaaggcaaggactttgttttaactgtaccttaagcggtcatgttctctgaagtggaatgtggctttcctaggaatgggtcgtacaaagctaagtggtaatgatgctatttggggaaaggtcttttttgcttaattttgttttttaaaactctgatgattgcttgagcaacaggcaggttatctgcctggttgaattctggttgaaccgtgtattctaatatttctggttaagtggtgactgggtaaggaaaccacttggggtagcagttcaacaattcacttacgaatgtttataagctttccatttcctaggtaattttttaaaagccagtcaaaacaaaaactttactgaaaatggacagaaataggaaatggactttttccttactgtctatacctcctgaaccttggtattgtaaagatctggggacctctgggtctgttctgaccattccctagtctccatggccaagcactcaaggattgatggacaccacacaccagctatattcatttgccaagatcaacagctccttctccaaacaactcaagcccccaattcccatcgcattccatttgggtgagatgcaactaacagccccttcctggatgaaggagtcaaagaataaagcttgcctagaggcatgcccca

SEQ ID NO: 202248 - DNA, 2661 bp, Homo sapiens
  Payload ID: 19893
  Gene Name: zinc finger protein 35
  Uniprot ID: P13682
  ENST ID: ENST00000396056
  CDS Start-End: 236-1819
acttcctgtccggtcattgttctcgtgccggtagaagctgaagtaccggtcagccagcctcctgctgcagagccagtgaactcaggtcgggcttctcagctgcgcacataggcagtactcatcttggccctgggaagaaactcaagaagaagcttttgaaacataaagcttggatggggtttgacctctgcagggcagcgcccagctataggagttcccctgctgagcagagaagatgactgcagaattgagagaagccatggccctagccccatggggcccagtgaaggtgaaaaaggaggaggaagaagaagaaaacttcccaggtcaggcatccagccaacaagtgcactccgagaacatcaaagtctgggccccagtgcagggtcttcagacaggccttgatggatcagaagaggaagaaaagggtcagaacatatcctgggatatggcggtagtcctgaaagcaactcaggaggcacctgctgcttcaacccttggcagctactcattaccagggactctggccaagagtgagatactggagactcatgggaccatgaactttctaggtgctgaaaccaagaacctacagttactggttccaaaaactgagatatgtgaggaagctgaaaaacccctcatcatatcagaaagaatccagaaagctgatcctcaaggacctgagttaggagaagcttgtgaaaagggaaacatgttaaagaggcagagaataaagagagaaaagaaagatttcagacaagtgatagtgaatgactgtcacttacctgaaagcttcaaagaagaggaaaaccagaaatgtaagaaatctggaggaaaatatagccttaattctggcgctgttaaaaatccaaaaacccagcttggacaaaagccttttacgtgtagcgtgtgtgggaaaggatttagtcagagtgcaaacctcgttgtgcatcagcgaatccacactggagagaaaccctttgaatgtcatgagtgtgggaaggccttcattcagagtgcaaacctcgttgtgcatcagagaatccacactggacagaaaccttatgtttgctcaaaatgtgggaaagccttcactcagagttcaaatctgactgtacatcaaaaaatccactccttagaaaaaacttttaagtgcaatgaatgtgagaaagcctttagttacagctcacaacttgctcggcaccagaaagtccacattacggaaaaatgctatgaatgtaatgaatgtgggaaaacatttactaggagctcaaacctcattgtccaccagaggatccacactggggagaagccctttgcctgtaacgactgtggcaaagcctttacccagagtgcaaatcttattgtacatcagcgaagccatactggtgagaagccatatgagtgtaaagagtgtgggaaagcctttagttgtttttcacaccttattgtgcaccagagaattcacactgcagagaaaccttacgactgcagcgaatgtgggaaagccttcagtcagctctcttgccttattgtccaccagagaattcacagtggagatcttccttacgtgtgtaatgaatgtgggaaggccttcacatgtagctcatacctacttattcatcagagaattcataatggagaaaaaccttacacatgtaatgagtgtgggaaggccttcagacagaggtcgagcctcaccgtgcaccagagaacccacactggggagaagccctatgaatgtgagaagtgtggtgcagctttcatttccaactcacacctcatgcgacaccatagaacccatcttgttgaataacaagtaaggaagaggaagacctccagcattggtcataaccttctgcctccctaatgagacacctctttgctgttttcttcctcctctataaaagtgagggctgtgtccttaaaagttatagttttcaggaatgcagcagaagacacaagaaaagcatttcagaggctaatttaaaacaaaaagtaagcacctaaaggcaaggactttgttttaactgtaccttaagcggtcatgttctctgaagtggaatgtggctttcctaggaatgggtcgtacaaagctaagtggtaatgatgctatttggggaaaggtcttttttgcttaattttgttttttaaaactctgatgattgcttgagcaacaggcaggttatctgcctggttgaattctggttgaaccgtgtattctaatatttctggttaagtggtgactgggtaaggaaaccacttggggtagcagttcaacaattcacttacgaatgtttataagctttccatttcctaggtaattttttaaaagccagtcaaaacaaaaactttactgaaaatggacagaaataggaaatggactttttccttactgtctatacctcctgaaccttggtattgtaaagatctggggacctctgggtctgttctgaccattccctagtctccatggccaagcactcaaggattgatggacaccacacaccagctatattcatttgccaagatcaacagctccttctccaaacaactcaagcccccaattcccatcgcattccatttgggtgagatgcaactaacagccccttcctggatgaaggagtcaaagaataaagcttgcctagaggcatgccc

SEQ ID NO: 202249 - DNA, 564 bp, Homo sapiens
  Payload ID: 19893
  Gene Name: zinc finger protein 35
  ENST ID: ENST00000399560
  CDS Start-End: 195-506
attgttctcgtgccggtagaagctgaagtaccggtcagccagcctcctgctgcagagccagtgaactcaggcagtactcatcttggccctgggaagaaactcaagaagaagcttttgaaacataaagcttggatggggtttgacctctgcagggcagcgcccagctataggagttcccctgctgagcagagaagatgactgcagaattgagagaagccatggccctagccccatggggcccagtgaaggtgaaaaaggaggaggaagaagaagaaaacttcccaggtcaggcatccagccaacaagtgcactccgagaacatcaaagtctgggccccagtgcagggtcttcagacaggccttgatggatcagaagaggaagaaaaggtgctgaaaccaagaacctacagttactggttccaaaaactgagatatgtgaggaagctgaaaaacccctcatcatatcagaaagaatccagaaagctgatcctcaaggacctgagttaggagaagcttgtgaaaagggaaacatgttaaagaggcagagaataaagagagaaaagaa

SEQ ID NO: 202250 - DNA, 581 bp, Homo sapiens
  Payload ID: 19893
  Gene Name: zinc finger protein 35
  ENST ID: ENST00000453164
  CDS Start-End: 195-506
gttctcgtgccggtagaagctgaagtaccggtcagccagcctcctgctgcagagccagtgaactcagtaggcagtactcatcttggccctgggaagaaactcaagaagaagcttttgaaacataaagcttggatggggtttgacctctgcagggcagcgcccagctataggagttcccctgctgagcagagaagatgactgcagaattgagagaagccatggccctagccccatggggcccagtgaaggtgaaaaaggaggaggaagaagaagaaaacttcccaggtcaggcatccagccaacaagtgcactccgagaacatcaaagtctgggccccagtgcagggtcttcagacaggccttgatggatcagaagaggaagaaaaggtgctgaaaccaagaacctacagttactggttccaaaaactgagatatgtgaggaagctgaaaaacccctcatcatatcagaaagaatccagaaagctgatcctcaaggacctgagttaggagaagcttgtgaaaagggaaacatgttaaagaggcagagaataaagagagaaaagaaagatttcagacaagtga

SEQ ID NO: 202251 - DNA, 532 bp, Homo sapiens
  Payload ID: 19893
  Gene Name: zinc finger protein 35
  ENST ID: ENST00000432115
  CDS Start-End: 196-532
cattgttctcgtgccggtagaagctgaagtaccggtcagccagcctcctgctgcagagccagtgaactcaggcagtactcatcttggccctgggaagaaactcaagaagaagcttttgaaacataaagcttggatggggtttgacctctgcagggcagcgcccagctataggagttcccctgctgagcagagaagatgactgcagaattgagagaagccatggccctagccccatggggcccagtgaaggtgaaaaaggaggaggaagaagaagaaaacttcccaggtcaggcatccagccaacaagtgcactccgagaacatcaaagtctgggccccagtgcagggtcttcagacaggccttgatggatcagaagaggaagaaaagggtcagaacatatcctgggatatggcggtagtcctgaaagcaactcaggaggcacctgctgcttcaacccttggcagctactcattaccagggactctggccaagagtgagatactggagactcatgggaccatgaactttctag

SEQ ID NO: 202252 - DNA, 620 bp, Homo sapiens
  Payload ID: 19893
  Gene Name: zinc finger protein 35
  ENST ID: ENST00000415571
  CDS Start-End: 219-620
cattgttctcgtgccggtagaagctgaagtaccggtcagccagcctcctgctgcagagccagtgaactcaggtcgggcttctcagctgcgcacagcagtactcatcttggccctgggaagaaactcaagaagaagcttttgaaacataaagcttggatggggtttgacctctgcagggcagcgcccagctataggagttcccctgctgagcagagaagatgactgcagaattgagagaagccatggccctagccccatggggcccagtgaaggtgaaaaaggaggaggaagaagaagaaaacttcccaggtcaggcatccagccaacaagtgcactccgagaacatcaaagtctgggccccagtgcagggtcttcagacaggccttgatggatcagaagaggaagaaaagggtcagaacatatcctgggatatggcggtagtcctgaaagcaactcaggaggcacctgctgcttcaacccttggcagctactcattaccagggactctggccaagagtgagatactggagactcatgggaccatgaactttctaggtgctgaaaccaagaacctacagttactggttccaaaaactgagatatgtgaggaagctgaaaaa

SEQ ID NO: 202253 - DNA, 2503 bp, Homo sapiens; identical to SEQ ID NO: 202247
  Payload ID: 19893
  Gene Name: zinc finger protein 35
  ENST ID: ENST00000629532
  CDS Start-End: 221-532

SEQ ID NO: 202254 - DNA, 2661 bp, Homo sapiens; identical to SEQ ID NO: 202248
  Payload ID: 19893
  Gene Name: zinc finger protein 35
  Uniprot ID: P13682
  ENST ID: ENST00000625394
  CDS Start-End: 236-1819

SEQ ID NO: 202255 - DNA, 564 bp, Homo sapiens; identical to SEQ ID NO: 202249
  Payload ID: 19893
  Gene Name: zinc finger protein 35
  ENST ID: ENST00000629627
  CDS Start-End: 195-506

SEQ ID NO: 202256 - DNA, 620 bp, Homo sapiens; identical to SEQ ID NO: 202252
  Payload ID: 19893
  Gene Name: zinc finger protein 35
  ENST ID: ENST00000627641
  CDS Start-End: 219-620

SEQ ID NO: 202257 - DNA, 532 bp, Homo sapiens; identical to SEQ ID NO: 202251
  Payload ID: 19893
  Gene Name: zinc finger protein 35
  ENST ID: ENST00000631045
  CDS Start-End: 196-532

SEQ ID NO: 202258 - DNA, 581 bp, Homo sapiens; identical to SEQ ID NO: 202250
  Payload ID: 19893
  Gene Name: zinc finger protein 35
  ENST ID: ENST00000630364
  CDS Start-End: 195-506

SEQ ID NO: 202259 - DNA, 2338 bp, Homo sapiens
  Payload ID: 19894
  Gene Name: zinc finger protein 350
  Uniprot ID: Q9GZX5
  ENST ID: ENST00000243644
  CDS Start-End: 229-1827
agcagtttacggaagtgtaacgttgaggcccttcttgtgtatctggagaaaatagaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaaggagaacaactgtggacaattgaagatggaatccacagtggagcctgttcagacatatggaaagttgatcatgtgctggagcgcttgcagagtgaaagcctggtgaacagaaggaaaccatgtcatgaacatgatgcatttgaaaatattgttcattgcagcaaaagtcagtttctgttagggcaaaatcatgatatatttgacttacgtggaaaaagtttgaaatccaatttaactttagttaaccagagcaaaggctatgaaataaagaactctgttgagtttactggaaatggggactcctttcttcatgctaaccatgaacgacttcatactgcaattaaattccctgcaagtcaaaaactcatcagcactaagtcccaattcatcagtcccaagcatcagaaaacacgaaaattagagaagcatcatgtgtgcagtgaatgtgggaaagccttcatcaagaagtcttggctaactgatcaccaggtaatgcatacaggagagaaaccccacagatgtagtctatgtgagaaagccttctccagaaagttcatgcttactgaacatcagcgaactcatacaggagaaaaaccttatgaatgccctgaatgtggcaaagcctttctcaagaaatcacggctcaacatacatcagaaaacacataccggagagaaaccctatatatgcagtgaatgtggaaaaggcttcatccagaaaggaaatctcattgtacaccagcgaattcatacaggtgagaaaccttatatatgcaatgaatgtggaaaaggcttcattcagaagacgtgtctcatagcacatcagagatttcacacaggaaagacgccctttgtgtgcagtgaatgtggaaaatcctgttctcagaaatcaggtctcattaaacatcaaagaattcacacaggagagaaaccctttgaatgtagtgaatgtgggaaagcctttagcacaaagcaaaagctcattgtccatcaaaggactcatacaggagagagaccctatggctgtaacgagtgtgggaaagcgtttgcgtatatgtcgtgtctggttaagcataagagaatacacacaagggagaaacaagaggcagccaaggtggaaaatcctcctgcagagaggcacagctcattacacaccagtgatgtcatgcaggagaaaaactctgctaacggggcgactacacaagtgccttctgtggcccctcagacatcattaaacatcagcggcctcctcgcaaacaggaacgtagtccttgtgggacagccagtggtcagatgtgcagcctcaggagataacagaggatttgcacaggacagaaaccttgtgaatgcagtgaatgtggttgtgccttccgtgatcaattatgtcttattttatgttacagaaaacccataggaagaaaactcagatctatgtggaaaagggttgagcaaaaatttgtagttcattatgtggccgaaaagcatacactgagagaacatgtataaggctgagatagcctgataaactcatcctattaaaatgtatgctgtgatacacaggcaaatttgatgttaacctaagcacatacacagcaattgctcgactgtgtcaattaaatgagtaaaggaagcccaagtacttttaagtggaggaaatgaagtactgtgaatttttaaaacagatgagataattggtgtcgggagtgttgcagtgactgaaaagcttcataaggggcagttggtgggaaagggctaatactgtaatggtggaatgtgggacacatatgtgtcaattcagtttccttagaccagtgccagtgtggaggattaattgaaaaccaggaccataaactttcagaactttgtattatgcagagggatctgtgaaactagtcaatttgtttcattaaacaaatattttaaaa

SEQ ID NO: 202260 - DNA, 553 bp, Homo sapiens
  Payload ID: 19894
  Gene Name: zinc finger protein 350
  ENST ID: ENST00000594929
  CDS Start-End: 352-553
gagcagtttacggaagtgtaacgttgaggcccttcttgtgtatctggagaaaatagagagtcttgctctcgtcgcccaggctggagtgtagtggcgtgcttggctcaactgcaacctctgccttctgggctcaagtgattcttgtgccacggcctcccgagtagctggaattaccagcaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaaggagaacaactgtgga

SEQ ID NO: 202261 - DNA, 533 bp, Homo sapiens
  Payload ID: 19894
  Gene Name: zinc finger protein 350
  ENST ID: ENST00000597788
  CDS Start-End: 348-533
ctccttgctgattgtctcttttctaaaactaatctgcctaagagttcaccatctcctgaggctggtgctatggtgggtctcatttcctacctgccttcacagtccttccacggaaacgtcacagaggaaaggcatacctccaccacattaagaatcctagacattattggccacaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaa

SEQ ID NO: 202262 - DNA, 869 bp, Homo sapiens
  Payload ID: 19894
  Gene Name: zinc finger protein 350
  ENST ID: ENST00000601430
  CDS Start-End: 381-869
ataaacccgtgcgaggactccagaagtaggagcagtttacggaagtgtaacgttgaggcccttcttgtgtatctggagaaaatagaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggactgttattacaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaaggagaacaactgtggacaattgaagatggaatccacagtggagcctgttcagacatatggaaagttgatcatgtgctggagcgcttgcagagtgaaagcctggtgaacagaaggaaaccatgtcatgaacatgatgcatttgaaaatattgttcattgcagcaaaagtcagtttctgttagggcaaaatcatgatatatttgacttacgtggaaaaagtttgaaatccaatttaactttagttaaccagagcaaaggctatgaaataaagaactctgttgagtttactggaaatggggactcctttcttcatgctaaccatgaacgacttcatactgcaattaaattccctgcaagtcaaaaactcatcagcactaagtcccaattcatcagtcccaagcatcagaaaaca

SEQ ID NO: 202263 - DNA, 489 bp, Homo sapiens
  Payload ID: 19894
  Gene Name: zinc finger protein 350
  ENST ID: ENST00000593596
  CDS Start-End: 333-489
acatagtttttggcaggaagactggggagcgccggggtataggcatttgggaggtacctggtgggagtctgtgatccccctgtctgtggtccgcgtgcctttggtgtgagtacagtgactaagggtctgtagtgatcaacggccgtgtcctaactgtcaaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagca

SEQ ID NO: 202264 - DNA, 2484 bp, Homo sapiens
  Payload ID: 19895
  Gene Name: zinc finger protein 354A
  Uniprot ID: O60765
  ENST ID: ENST00000335815
  CDS Start-End: 199-2016
ccggcgcgccgcggggtgagcggcgccgggcctgaggtcgcccagacgccgtcggggcggagccgggtcgcgaggctgcatcccggccggcggttccggagcctcgcggctggggaggcgcggcccgggacgctcgagcttagggagatctgccttctggagactgcgccgtcctcccgggagagccagaaagaggacatggctgctgggcagcgggaagcgaggccccaggtgtcactgacgtttgaggatgtggctgtgctgtttacccgagatgagtggagaaagctggccccttctcagagaaacttgtaccgggatgtgatgctggagaactataggaacctggtctcactggggctcccatttaccaaaccaaaagtgatctccctgttgcagcaaggagaagatccctgggaggtggagaaagacggttctggcgtctcctctctaggatcgaagagcagtcataaaaccacaaagtcaacgcaaacacaagactcttcatttcagggactgatactgaaaagatccaacaggaatgtaccttgggatttgaaattagaaaagccttacatatatgaaggcagattagagaaaaagcaggataaaaagggaagttttcagatagtttcagccacccacaaaaaaatccccactatagaaagaagccataaaaatactgaattgagccaaaacttcagcccaaagtcagtgcttattaggcaacagatacttcccagagaaaaaacaccaccaaaatgtgaaatacaaggaaacagcctcaaacagaattcacaattacttaatcaaccaaaaattacagcagataaacgctataaatgtagtctgtgtgaaaaaaccttcattaacacttcatcccttcgtaaacatgagaaaaaccatagtggagagaaactatttaagtgtaaagaatgttcaaaagcctttagccaaagttcagctcttattcaacatcaaataacgcatactggagagaaaccctacatatgtaaagaatgtgggaaagcctttactctcagtacatccctttataaacatctaagaacccatactgtggagaaatcctacagatgtaaagaatgtggtaaatccttcagccgaaggtcaggcctttttatacatcaaaaaattcatgctgaagaaaacccttgtaagtataatccgggtaggaaggcatctagttgcagcacatccctttctggatgtcaaagaattcattctagaaagaagtcctacttatgtaatgaatgtggcaacacctttaagtctagctcatcccttcgttatcatcagagaattcacactggagagaagccttttaaatgtagtgaatgtgggagagccttcagccagagtgcctctcttattcaacatgaaagaattcacaccggagaaaagccctatagatgcaatgaatgtgggaaaggctttacttctatttcacgacttaatagacaccgaatcattcatactggagagaagttttataattgtaatgaatgtggtaaagccttaagctcccactcaacacttattattcacgagcgaattcatactggagaaaaaccatgtaaatgtaaagtatgtggaaaagccttcagacagagttcagctctcattcaacatcagagaatgcatactggagaaagaccctataaatgtaacgagtgtgggaaaacattcaggtgtaactcatcacttagtaatcaccagagaattcatactggagagaaaccatatcgatgtgaggaatgtgggatatcttttggccaaagttcagctcttattcagcatcgaaggattcatacaggagaaaaaccctttaaatgtaatacatgtggaaaaacttttagacaaagctcatcacgtattgcacatcagagaattcatactggagagaaaccctatgaatgtaatacatgtgggaaacttttcaaccataggtcatcccttactaatcattataaaattcatatcgaagaggacccctagaaagtagatttgtatgtgtgaaagccttaaaccaaagctcatcgaagaatacatccttgagagagatgtaataaatgtaatggatgtgaaaaaaactgtaataatttagccctcattaggtatttaattccatggataaacctcagctatataatagatatgaggaaagtgtttgtgcctgtcagacacttaaaaaaataacctgagatgaagaatttacaattgaagacattgactttagccatttgtgaaatgggtttgctttttcccttttcctacagacgtatatgctagatgtcacgtgatcatcagaaacagatatccgagtgggtggggaggtgtgctttagatttctcattagaagaccaccaaactggtaatatttttatagcattttaatagcttgatcaaattgtacctttttagagaaaaggaccaaaataaaagaaaaatgaattatgaactacc

SEQ ID NO: 202265 - DNA, 564 bp, Homo sapiens
  Payload ID: 19895
  Gene Name: zinc finger protein 354A
  ENST ID: ENST00000518048
  CDS Start-End: 156-356
agacgccgtcggggcggagccgggtcgcgaggctgcatcccggccggcggttccggagcctcgcggctggggaggcgcggcccgggacgctcgagcttagggagatctgccttctggagactgcgccgtcctcccgggagagccagaaagaggacatggctgctgggcagcgggaagcgaggccccaggtgtcactgacgtttgaggatgtggctgtgctgtttacccgagatgagtggagaaagctggccccttctcagagaaacttgtaccgggatgtgatgctggagaactataggaacctggtctcactggggccatacataaacaggcagtggtctgaatttggcccatgacccgtagtttgctgatcactgccatccttaaaagggagtcacataggccgggcgcggtggctcacacctgtaatcccagcactttgggaggccgaggcgggcagatcacaagggctcccatttaccaaaccaaaagtgatctccctgttgcagcaaggagaagatccctgggaggtggagaaagacggttctggcgtctcctctctag

SEQ ID NO: 202266 - DNA, 766 bp, Homo sapiens
  Payload ID: 19895
  Gene Name: zinc finger protein 354A
  ENST ID: ENST00000520331
  CDS Start-End: 362-766
gtgcagtgggtgctggcagtgccagctggcgccgaggaactcagcggcgtggggcgagccctggccctggtgggctcagcgggtcgctgctgccactgcggctccagcgtcccctccgtaagccccaagcctgtggggcctgggcctggccgggcggcccagcgctgctctggtccgcgggctcctggctcctcccgaatccctgtgagggcgcgcggggtccttctcagcgggagtcggggttttagagctgcggattccagggctggaaagcagaaggggttcttcctggctccctttttcttctcagatctgccttctggagactgcgccgtcctcccgggagagccagaaagaggacatggctgctgggcagcgggaagcgaggccccaggtgtcactgacgtttgaggatgtggctgtgctgtttacccgagatgagtggagaaagctggccccttctcagagaaacttgtaccgggatgtgatgctggagaactataggaacctggtctcactggggctcccatttaccaaaccaaaagtgatctccctgttgcagcaaggagaagatccctgggaggtggagaaagacggttctggcgtctcctctctaggatcgaagagcagtcataaaaccacaaagtcaacgcaaacacaagactcttcatttcagggactgatactgaaaagatccaacaggaatgtaccttgggatttgaaattagaaaagccttacatatatgaaggcagattagagaaaaag

SEQ ID NO: 202267 - DNA, 2802 bp, Homo sapiens
  Payload ID: 19896
  Gene Name: zinc finger protein 354B
  Uniprot ID: Q96LW1
  ENST ID: ENST00000322434
  CDS Start-End: 227-2065
agcggccgccttgctcctctaggtcccaggcgctctgcggagctttcgctgcccggtgagcggcgccgggcttgaggtcgcccagacgtcggaggagccgggtcacgaggctggagcttcctgcttgcagagtgcggcggggaggcgcggcccgggaacgcgggatcctggggagatctgccttctggagactgcgccgtcctcccgggagagccagaaagaggacatggctgctgggcagcgggaagcgaggccccaggtgtcactgacattcgaggacgtggctgtgctctttacctgggatgagtggagaaagctggctccttctcagagaaacttgtaccgggatgtgatgctggagaactataggaacctggtctcactgggactctcatttaccaaaccaaaagtcatctccctgttgcagcaaggagaagatccctgggaggtggagaaagacagttctggtgtctcctctctaggatgtaagagcacacctaaaatgacaaagtcaactcaaactcaggattcatttcaggagcagataaggaaaagattgaaaagggatgaaccctggaacttcatatcagaaagatcctgcatatatgaagagaaattaaagaaacagcaggacaaaaatgaaaatttacaaataatttcagttgcccatacaaaaatccttactgtagatagaagccataaaaatgttgaatttggccaaaacttctacctgaaatcagtcttcattaagcaacagagatttgctaaagaaaaaactccatcaaaatgtgaaatacaaagaaatagtttcaagcagaattcaaatttacttaaccaatcaaaaatcaaaacagcagagaaacgctataaatgcagtacatgtgaaaaagccttcattcacaattcatcccttcgtaaacatcagaaaaaccacactggagaaaaattatttaaatgtaaagaatgtttaaaagctttcagccaaagttctgctcttattcaacatcaaagaactcatacaggagagaaaccctatatatgtaaagaatgtgggaaagccttcagccatagtgcatccctttgtaagcatttaaggacccatactgtggagaaatgctatagatgtaaagaatgtggtaaatccttcagtcgaaggtctgggctttttatacatcaaaaaatccatgctcaagaaaatccccataaatacaatccaggcaggaaggcatccagttacagcacttccctttctggaagtcagaaaattcatctcagaaagaagtcctacttatgtaatgaatgtggcaacacctttaagtctagctcatcccttcgttatcatcagagaattcacactggagagaagccttttaaatgtagtgaatgtgggagagccttcagccagagtgcctctcttattcaacatgaaagaattcacaccggagaaaagccctatagatgcaatgaatgtgggaaaggctttacttctatttcacgacttaatagacaccgaataattcatactggagagaaattgtataattgtaatgaatgtggtaaagccttaagctcccactcaacacttattattcatgagcgaattcatactggagaaaaaccatgtaaatgtaaagtatgtggaaaagccttcagacagagttccgctctcattcaacatcagagaatgcatactggagaaagaccctataagtgtaacgaatgtgacaaaacattcaggtgtaactcatcgcttagtaatcaccagagaattcatactggagagaaaccatatcgatgtttagaatgtgggatgtcttttggccaaagtgcagctcttatacaacatcagaggattcatacaggagaaaaaccctttaaatgtaatacatgtggaaaaacttttagacaaagctcatcacttattgcacatcaaagaattcatactggagagaaaccctatgaatgtaatgcatgtgggaaactctttagccagaggtcatcccttactaatcattataaaattcacattgaagaggactccttaaaagccgatttgcatgtgtgaaagccttaaaccaaaactcatcagagaatacatgcttgagagtgatttattaaatataatgaatatgagaaaactcttagttctcatcagatactaagttttaagaataaactttagctatgtaataacttatgggaaaagcttttatacttgtcactcactttttaaaatatcccgagacagttcactgttgcagacattgaaattggccatttgtaagataaaaggtatgtttataaaatctctttatataatatatgctatctatgacatgcaaaaaagaaaagtctgggtgctgaggtgctgaatttttcattagaaaaacatttgtataaactactattatataaatataagcatatttattacagcaaacattttaatagcaaacaaaacaattgatcttaaaaatatatgcaatatatacttacctggcagggaagattaccatgatcacgaaggtggttttcccagggcaaggcttatccattgcactccagatgtgctgaccccttcaatttcccaaaatgtggaaaactcaactgcataatttatggtagtgggggactacattcgcactttctcctgaaatatatatatatatgcagtattagagcaaaggaccaataagagataaaaactaactgaactacctcttagtgcctggaatttaccttttcctgacttactgtcaaacttcgtgcatggcttttattaaaaaagaaaaaatctgttct

SEQ ID NO: 202268 - DNA, 763 bp, Homo sapiens
  Payload ID: 19896
  Gene Name: zinc finger protein 354B
  ENST ID: ENST00000520377
  CDS Start-End: 362-763
gtgcagtgggtgctggcagtgccagctggcgccgaggaactcagcggcgtggggcgagccctggccctggtgggctcagcgggtcgctgctgccactgcgggtccagcgtcccctccgtaagccccaagcctgtggggcctgggcctggccgggcggcccagcgctgctctggtccgcgggctcctggctcctcccgaatccctgtgagggcgcgcggggtccttctcagcgggagtcggggttttagagctgcggattccagggctggaaagcagaaggggttcttcctggctccctttttcttctcagatctgccttctggagactgcgccgtcctcccgggagagccagaaagaggacatggctgctgggcagcgggaagcgaggccccaggtgtcactgacattcgaggacgtggctgtgctctttacctgggatgagtggagaaagctggctccttctcagagaaacttgtaccgggatgtgatgctggagaactataggaacctggtctcactgggactctcatttaccaaaccaaaagtcatctccctgttgcagcaaggagaagatccctgggaggtggagaaagacagttctggtgtctcctctctaggatgtaagagcacacctaaaatgacaaagtcaactcaaactcaggattcatttcaggagcagataaggaaaagattgaaaagggatgaaccctggaacttcatatcagaaagatcctgcatatatgaagagaaattaaagaaacag

SEQ ID NO: 202269 - DNA, 5411 bp, Homo sapiens
  Payload ID: 19897
  Gene Name: zinc finger protein 354C
  Uniprot ID: Q86Y25
  ENST ID: ENST00000315475
  CDS Start-End: 307-1971
ctttcgggggttctcctggcttgggccatccaggcttggctaggattgccggcctggggttgaggcgctcgcagtggtctcttccgggccggggtggatccgggcctctccagcgagtgggcggcgtgcagcctcgtctgggcttctgggaccagccctacgcggctcgggccccttggccactgggtcccggggcgccgtccgcgagcggcctggactgccggagacccgcgggagggagcgcctcgccagacccaccgtgtccacactctgctctccctgggcaggaagactgaggaggaagggatggctgtggatctgctgtctgctcaggagcctgtgacattcagggatgtggccgtgttcttcagccaggacgagtggttgcacctggactctgcccagagggccttgtaccgggaggtgatgctggagaactacagcagcctggtctcactggggattccattttcaatgccaaagttgattcatcagttgcagcaaggagaagatccctgcatggtggaaagagaagtcccttcagatacccgtctaggtttcaagacttggcttgaaacagaagcattgcctcatagacaggacatttttatagaagaaacatctcagggaatggtaaagaaagaatccattaaggatggtcactgggacattaactttgaagaagctgtggaatttgagagcgagatagaagaagagcaagagaagaaacctcttagacaaatgatagattcgcatgagaaaaccatcagtgaagatggaaaccatacaagtcttgaattggggaaaagcttatttacaaatacagctcttgtcacacaacagagtgttcctatagaaaggatacccaatatgtattatacatttgggaaagattttaaacagaattttgatctcatgaaatgcttccagatttacccaggaggaaaacctcacatctgtaatgaatgtgggaagagcttcaagcagaatctgcatcttattgaacatcagagaattcatacaggtgagaaaccctacaaatgtaatgagtgtgaaaaaaccttcagccacagatcatcccttctttctcatcagagaattcatactggagagaaaccttacaagtgtaatgaatgtgagaaggcatttagcaacagttcaacccttatcaaacatctgagagtgcatactggagagaaaccgtatcgatgtagggaatgtggtaaagcctttagccagtgttcaaccctcactgtacatcagagaattcatactggagagaaactctataaatgcggcgaatgtgagaaggccttcaactgtagagcaaaacttcacaggcatcaaagaatccatacaggtgagaaaccctataaatgtagtgagtgtgggaagggatacagccagtttacatctctagctgaacatcagaggtttcatactggagaacaactgtatacatgcttggaatgtgggagaaccttcacacgtattgtaacccttatcgaacatcagcgaattcacactggacaaaaaccttatcagtgcaacgaatgtgagaaagccttcaaccagtattcatcctttaatgaacatcggaaaattcatactggggaaaaactttatacatgtgaggaatgtgggaaagcctttggttgcaaatctaacctttataggcatcagagaattcatactggagagaaaccgtatcagtgtaatcagtgtggaaaggccttcagccagtattcatttttaaccgaacatgagaggatccacactggagagaaactgtataaatgtatggaatgtgggaaagcctacagttacagatcaaacctttgtagacacaaaaaagttcacacgaaagagaaactctataagtggaaggaatatgggaaacctttcatctgcagctcctcacttacccagtatcagagattttttaaaggagataaagcctatgaggtttagttcatctctcaaataatccaagacttctcactggggaataagggaataataaatagggtacaaactcctaatagatttgtcttttttacttctcctgaaggaaatatgttagttgccactaagtcatgataaaattgatcagtgagactatgaagagcactgacttgttaaattttaaaagaaccataaattctaaggtatctaaaaacctatgagtatttaattcatagaaaaaatgtaaaaggtctttttaaaaatcatgaaaaatagttgaatatacattttgtttctctcataagaccatattccctttaaaagagtaagcttcaatatgtgaattttcttttaaaaacagtcactgagttaataatgtaaataagtgtgtggccttctttaaaatagctggctaacataggaggcacttcttttcataaagagaagctaaacataaaaaggaattttaaatttaactcttcacatggaaataataaagctctttatatgagctgtcccaccagcaacttatatatgtaaacatacatatatacacatatgcatgtgtgtgtgtaaacataaaagtcctttattattaaaaaatgtagttttattgatttagaatttagttcttaaaatcttgcccaaaggtagactctctttcttttactttcttccattatttcttaaattgatgtggttttatataactgaacagagtactattacagtaccgtagaaggcggattaactgaagcagctggaaagactgtcaagcacatactttgttatctgttgcagaagggatgtatttggcagaatctcaggctgcatgtctggtagctcattagagccaggagagattttagtttaattatagcctttcattgtactaacgaaggatttgaacttagtgaacagagtcaagactagaatctaggtctttggttctggtgttttgtgatcattataggctcgtttccaacctgaggtcccaagagtactatttgttttgtagcctggttagacatagttgcagtaatttaaagttactgtgttatctttaagggcttcctctcaccttaatcttaataattgactcacaactatattcttttttcttatgagtccctaattatgcctgcttttgttataattgtacttaaatccttaaagctagctgaggtccagatagtgtaattgcttttggaggcttcacatataaggttgccttcttattacacatattttaggaattaattattttatggaaagttatatatgaagagtttattattaagcattcctttcatcagtttaaatgtttaattcctcccaggcgtttttcctccaattttatatttgatttttcattcaattcacagttggtatcattaaaaaaaattctaatacaattagctagaccttctgagaaaaatgttagaattaaactcaagcagtcagtatagtatatttcttaaccgactggttttagcttatcagaaagtaattattttatgtatttaaatacatttacaaagaaaatgaggcttttaaacagacctcactatttaacattgtacccagtagtggtgagcatgcttagtacccaaattttggtttctaaatgccattccccactaaaaggaaccagggttccttggagaaatggctgattccatgtttggagcaggggaagtgggtggtgtggctaaaatactttttattaagaaaataaaataaaaagcaagatagtatttgaagactaatggggtaatgtcagaagggaacaggcgccaagttgaaggtattctcactggccaaatttaggacaacttagaataatcactcttactggtgataatactaagaaggaaaagaagttcataatgatgaaagtagagaaaaaagaaaactctatacaattatttgaagaatgtcttcttttaaatgtacatggaatgatagatttggaaaaattaccattttacaacccttaatgtaattaaatctggcaaaaatcgatggtaaaacccattaagtggaaaaaattttaaggaactttgtttacaaggtgtcagaacatcacagatatctattgcaaaagaattgcctttacagtgagatttggctatcaaactgcatttcactacttctggaataagccagcattatgtggctcttgatgggatgcggtatgaagcatgtgtgatcatccttgatgtactgccgaaaatgtttacctcaaatttaattaaatcttttgtctagacttatcttcctgtttaaagaaatacaggaatagaggaacaagttgaattacacagtatggaaataaatagacaagtccagagttggtataggacaactggacttttttttatatatttattttaaaatggttttcttaaatttatttttttaaacataacacgaggaagctgttaaaactggtgtaatagctcaaaagaactaagtattccagatttcgggagggatgaagagggagatattcagaaaccttcaccagattcctcccaacttgatcatagtggattaatgacgtgctttgtggatgtggttagtcaatgacaccagcttgacggatctttctttctgcaccaaaccccattgagttatctggtccccttggctgacgaagagccattaggcgaggatcactggcatcatccagggtgatgttcttcaagcgactgaccaaccgatcaggtcgaggagctgcaacagccttggggccctcacagactcgccaaacattccaggcactgcacttgccagtgcgctgatgaagaatcacggagaactccacctcatctcctgcctggagctcaaggccatcctcaacttctttcatatggaaaaagagcttcttgctatcccctacttcatagttaatgaagccaaactgatcttgcacacattccactggccctacgcaggggtgtgatgttgtaagccatagtttgtgcattttggccctggtctggacttttcaaaaagcaaatgtagtaaaacaaaaagtggtctctgctagattaagacaagagacataaccaaatggaaagtgtgatcctttattagcttctgattcataaaaaaacctataagagacatttggggggatatttggggaaataggaagatggaatgggtagtagataatgtggtatatttgatttttctagaagtgataattgagttacgtaggataatgttctaattcttaggagatgcatgcagaagttttttttttaagttttgaaaagtcatgatgttgacagcatattttcaaataaatatgtacaaaatcagtcaattgttttttgtggtggatctatatgtggtggatgttcattggtcatttaaaacatttttctatgtgtgtcaatttttaataaaaatgcaaaaagtgattggataaagaa

SEQ ID NO: 202270 - DNA, 1824 bp, Homo sapiens
  Payload ID: 19898
  Gene Name: zinc finger protein 358
  Uniprot ID: Q9NW07
  ENST ID: ENST00000394341
  CDS Start-End: 42-1748
caggtcttgccccagaagctgcgggcacatccacgcctgaaatgcggcgctcagtcctggtcaggaacccaggccacaaaggcctgagacccgtttatgaagagctcgactctgactccgaggacctagaccccaatcctgaagatctggacccggtttctgaagacccagagcctgatcctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcgatccagatgtgattggccccgtacccctgattctcgatcctaacagcgacaccctcagccccggcgatccaaaagtggaccccatctcctctggcctcactgccaccccccaggtcttggccaccagccccgcggtgctccccgcccccgccagcccgccccggcccttctcctgcccggattgcgggcgagccttccgccgcagctccgggctgagccagcatcgccgcacgcacagcggcgagaagccgtaccgctgccccgactgcgggaagtccttcagccacggtgccaccctggctcagcaccgtggcatccacactggggcgcggccgtaccagtgcgcggcctgcggcaaggccttcggctggcgctccacgctgctgaaacatcgcagcagccacagcggggagaagccgcaccactgcccggtgtgtggcaaggccttcgggcacggctcgctcctggcacagcacctgcgcacgcacggcggcccgcggccccacaagtgcccggtgtgcgccaagggcttcggccagggctctgcgctgctcaaacacctgcgcacgcacacgggcgagcggccctacccgtgtccgcagtgcggcaaggccttcgggcagagctcggcgctgctgcagcaccagcgcacacacacggccgagcgcccctaccgctgcccccactgcggcaaagccttcgggcagagctccaacttgcaacaccacctgcgcatccacacgggcgagcggccctacgcctgcccgcactgctccaaggccttcggccagagctcagcgctgctccagcacctgcacgtgcattcgggcgagcgtccctatcgctgtcagctctgcgggaaggccttcggccaggcctccagcctcaccaagcacaaacgggtgcatgagggtgcagccgctgctgcagctgccgcggccgctgcagctgcagcagcggccgccggcctgggcctcgggcctggcctaagccctgcatccatgatgaggccggggcaggtctccctcctgggtcctgatgctgtttctgtgctcggctctggcttgggcctcagccctggcaccagctctggccgcaaccctgaccctggctctgggccgggcactctgccggatcccagctccaaacccctccccggctccagatccacccccagccctactcctgtggaatcttctgacccaaaggctgggcacgacgctggtcccgaccttgtgcccagcccagaccttgatcctgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgcctccgg

SEQ ID NO: 202271 - DNA, 1954 bp, Homo sapiens
  Payload ID: 19898
  Gene Name: zinc finger protein 358
  Uniprot ID: Q9NW07
  ENST ID: ENST00000597229
  CDS Start-End: 171-1877
ggagcgcctggcggggccgctgggccgagggggccgccggcggggctggcgggcggggggcttcctgcgggcccggggggagccggcggccggcgcgggcgcggcgggccgggcaggggcgaggggcgccgggtcttgccccagaagctgcgggcacatccacgcctgaaatgcggcgctcagtcctggtcaggaacccaggccacaaaggcctgagacccgtttatgaagagctcgactctgactccgaggacctagaccccaatcctgaagatctggacccggtttctgaagacccagagcctgatcctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcgatccagatgtgattggccccgtacccctgattctcgatcctaacagcgacaccctcagccccggcgatccaaaagtggaccccatctcctctggcctcactgccaccccccaggtcttggccaccagccccgcggtgctccccgcccccgccagcccgccccggcccttctcctgcccggattgcgggcgagccttccgccgcagctccgggctgagccagcatcgccgcacgcacagcggcgagaagccgtaccgctgccccgactgcgggaagtccttcagccacggtgccaccctggctcagcaccgtggcatccacactggggcgcggccgtaccagtgcgcggcctgcggcaaggccttcggctggcgctccacgctgctgaaacatcgcagcagccacagcggggagaagccgcaccactgcccggtgtgtggcaaggccttcgggcacggctcgctcctggcacagcacctgcgcacgcacggcggcccgcggccccacaagtgcccggtgtgcgccaagggcttcggccagggctctgcgctgctcaaacacctgcgcacgcacacgggcgagcggccctacccgtgtccgcagtgcggcaaggccttcgggcagagctcggcgctgctgcagcaccagcgcacacacacggccgagcgcccctaccgctgcccccactgcggcaaagccttcgggcagagctccaacttgcaacaccacctgcgcatccacacgggcgagcggccctacgcctgcccgcactgctccaaggccttcggccagagctcagcgctgctccagcacctgcacgtgcattcgggcgagcgtccctatcgctgtcagctctgcgggaaggccttcggccaggcctccagcctcaccaagcacaaacgggtgcatgagggtgcagccgctgctgcagctgccgcggccgctgcagctgcagcagcggccgccggcctgggcctcgggcctggcctaagccctgcatccatgatgaggccggggcaggtctccctcctgggtcctgatgctgtttctgtgctcggctctggcttgggcctcagccctggcaccagctctggccgcaaccctgaccctggctctgggccgggcactctgccggatcccagctccaaacccctccccggctccagatccacccccagccctactcctgtggaatcttctgacccaaaggctgggcacgacgctggtcccgaccttgtgcccagcccagaccttgatcctgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgcctccggg

SEQ ID NO: 202272 - DNA, 662 bp, Homo sapiens
  Payload ID: 19898
  Gene Name: zinc finger protein 358
  ENST ID: ENST00000596712
  CDS Start-End: 154-662
tctccaaggaaagtttgccccgagcccttcccggcccggcgtagggttctccggaaaccatcactcacatctagcacttggaggcctccagggacagcggtgacccaccatctgggtcttgccccagaagctgcgggcacatccacgcctgaaatgcggcgctcagtcctggtcaggaacccaggccacaaaggcctgagacccgtttatgaagagctcgactctgactccgaggacctagaccccaatcctgaagatctggacccggtttctgaagacccagagcctgatcctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcgatccagatgtgattggccccgtacccctgattctcgatcctaacagcgacaccctcagccccggcgatccaaaagtggaccccatctcctctggcctcactgccaccccccaggtcttggccaccagccccgcggtgctccccgcccccgccagcccgccccggcccttctcctgcccggattgcgggcgagccttccgccgcagctccgggctgagccagcatcg

SEQ ID NO: 202273 - DNA, 2936 bp, Homo sapiens
  Payload ID: 19899
  Gene Name: zinc finger protein 362
  Uniprot ID: Q5T0B9
  ENST ID: ENST00000373428
  CDS Start-End: 1-1263
atgagtagaagttcaccaagtgggaaaggacactctaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccagaatccacacaggcgacagaccctacaagtgcccacatcctggctgcgagaaggctttcactcagctctccaacctccagtctcaccagcgccagcacaacaaggacaagccctacaagtgtcccaactgctaccgggcctattcggactccgcttctttgcagatccacctctcggcccacgccatcaagcacgccaaggcctactgctgcagcatgtgtgggcgggcctacacctcggagacctacctgatgaagcacatgtccaaacacacggtggtggagcacctggtgagccatcactcgccccagaggacggagtcccccggcatcccggtgcgaatctctctcatctgagcccactggaggcgccgccccacccggcccactggcagacacagacccaggcagcaccaggccccagctccctccgggggccctccaggaaccaccaagctctctcacgaccttcccaatcttccagaaagcttggtccgcagaagccctgcctggtccagtccgggggcggccaggccaactgcaagattctggactgttttggtggcatccaaagacgatctcagagcactttgaacctctctgttgagttttctttttgttccccacccttcacttgcttcactgtttttttttttttcgttttttttttttaagtttgttttggaaataacagaaaagatatttattggccaggaagttggtgctgctaagaccgagaaatttaaagaatcggacagatggacgcagagaaccagagggcaatgtgggaccttctcttgccatggcctcaggtcttgagggaaggctcgggcctaggtttctggactgcaaaggggacccccaggtgggaggggcaggaagcagccggagtgagcccttcgcccctgagtgcctggctcgcacctctcgagctgtgccctgggcatcactgagcagaggggtgcggcagcttcaggaggcagaaacgagaggggtgggagatccacaggaccaaagggtgcagtgatgggctgggtggcgggcccagggaaatggggtggggatgggctgggtaagacctggccctcccctgctgccctgaagaccaccccagtctacctcggtgctggccaggaaacctttcggctacctctcccaccatcccagactgtgggcagggggatggggagggagtgggcctggatctgggacctccctccagaatttcctccagatgggggcagtgcccagggaggggttatttgtcttccctgccatggagtgggaatccccagccgaggccctaggcccctcagcagggaagggatccccggggaggcaggtcccaggagcagaccctgcccccagcccccacagacacaccccaatctgaaagccatgcgtgtcggtgtatataggaaccatgtacagagcccagagaagccccctacatccccccgggaaaaaaaagaaaactagacagaaactcatctatatattctgtatctggagttccgttttgaatattaactgtgttatttttatacactttttaagccttaactcgccattgatttaccagtttaacgtttcctggggtttctttgcccatggggttctctgcccccacccccggccctttgtttgacttgcgtcgtctgatactcagtattgtagctttttgtccgcatgttactccctgtaaatacgctgttatacatactgttaacacccctttgctttttctatgggacctccaggccaccatatttagaactagttaccttattaaaaaagaaaaaacagtctgttggcttctcagtctgcatcttggaggcagggaggtgagggcaggtgcccctcagacacttcaggaaggtagtttgcattctatttaaaaaagggagtggggagcaaatgaaaatcaaatgtggggggaaaacactaaagggggcaagaaacaaaggaattacaaaccctctgctctttgtatttctctgttgtgaagaataaactgtacctgcacccgg

SEQ ID NO: 202274 - DNA, 712 bp, Homo sapiens
  Payload ID: 19899
  Gene Name: zinc finger protein 362
  ENST ID: ENST00000483388
  CDS Start-End: 112-712
agagccggagcccgagcccggagcctgtgccggagccccagcccggccctgctcgggccgccgggcgcggggctgcggccgcgtcccggaggcgccgccagcacagccaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatccca

SEQ ID NO: 202275 - DNA, 3106 bp, Homo sapiens
  Payload ID: 19899
  Gene Name: zinc finger protein 362
  Uniprot ID: Q5T0B9
  ENST ID: ENST00000539719
  CDS Start-End: 171-1433
gccggagccccagcccggccctgctcgggccgccgggcgcggggctgcggccgcgtcccggaggcgccgccagcacagccaggtgctgttgggaacacagaggaagtgactggctgggggttcagggaaagctccgtagaagagggaacacttgagctgggtcttgaaggatgagtagaagttcaccaagtgggaaaggacactctaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccagaatccacacaggcgacagaccctacaagtgcccacatcctggctgcgagaaggctttcactcagctctccaacctccagtctcaccagcgccagcacaacaaggacaagccctacaagtgtcccaactgctaccgggcctattcggactccgcttctttgcagatccacctctcggcccacgccatcaagcacgccaaggcctactgctgcagcatgtgtgggcgggcctacacctcggagacctacctgatgaagcacatgtccaaacacacggtggtggagcacctggtgagccatcactcgccccagaggacggagtcccccggcatcccggtgcgaatctctctcatctgagcccactggaggcgccgccccacccggcccactggcagacacagacccaggcagcaccaggccccagctccctccgggggccctccaggaaccaccaagctctctcacgaccttcccaatcttccagaaagcttggtccgcagaagccctgcctggtccagtccgggggcggccaggccaactgcaagattctggactgttttggtggcatccaaagacgatctcagagcactttgaacctctctgttgagttttctttttgttccccacccttcacttgcttcactgtttttttttttttcgttttttttttttaagtttgttttggaaataacagaaaagatatttattggccaggaagttggtgctgctaagaccgagaaatttaaagaatcggacagatggacgcagagaaccagagggcaatgtgggaccttctcttgccatggcctcaggtcttgagggaaggctcgggcctaggtttctggactgcaaaggggacccccaggtgggaggggcaggaagcagccggagtgagcccttcgcccctgagtgcctggctcgcacctctcgagctgtgccctgggcatcactgagcagaggggtgcggcagcttcaggaggcagaaacgagaggggtgggagatccacaggaccaaagggtgcagtgatgggctgggtggcgggcccagggaaatggggtggggatgggctgggtaagacctggccctcccctgctgccctgaagaccaccccagtctacctcggtgctggccaggaaacctttcggctacctctcccaccatcccagactgtgggcagggggatggggagggagtgggcctggatctgggacctccctccagaatttcctccagatgggggcagtgcccagggaggggttatttgtcttccctgccatggagtgggaatccccagccgaggccctaggcccctcagcagggaagggatccccggggaggcaggtcccaggagcagaccctgcccccagcccccacagacacaccccaatctgaaagccatgcgtgtcggtgtatataggaaccatgtacagagcccagagaagccccctacatccccccgggaaaaaaaagaaaactagacagaaactcatctatatattctgtatctggagttccgttttgaatattaactgtgttatttttatacactttttaagccttaactcgccattgatttaccagtttaacgtttcctggggtttctttgcccatggggttctctgcccccacccccggccctttgtttgacttgcgtcgtctgatactcagtattgtagctttttgtccgcatgttactccctgtaaatacgctgttatacatactgttaacacccctttgctttttctatgggacctccaggccaccatatttagaactagttaccttattaaaaaagaaaaaacagtctgttggcttctcagtctgcatcttggaggcagggaggtgagggcaggtgcccctcagacacttcaggaaggtagtttgcattctatttaaaaaagggagtggggagcaaatgaaaatcaaatgtggggggaaaacactaaagggggcaagaaacaaaggaattacaaaccctctgctctttgtatttctctgttgtgaagaataaactgtacctgcacccgg

SEQ ID NO: 202276 - DNA, 538 bp, Homo sapiens
  Payload ID: 19900
  Gene Name: zinc finger protein 365
  ENST ID: ENST00000344640
  CDS Start-End: 154-351
ctgggtcaaagggtgaagtagaaggaagctggaaacacatagtattttagaagtttttcagagaaatcacaaggcaggaacttctgctcagtttggaagaaagagcattccatcatgacccttggactgggtgagagcatcatcctttaattaatgtctgcgctgggtcagataaccatcactgtctccaggtgctggaatacagagaggaaccaaacagataaaaatccttgcctgcacggagcttaccttcagctaagggagacagtcaaaaacaaggatttagccaaatttgggtgctatttcccttttgtggagggacttttcatcacaatgagaaggacgtcttaggactccaggactttgagaggcaaattgacaatcatcgatttgttgactgaacacctgttaggtgtaaggcacggtgtcatatgctttccttggggcttgccttcaagcagctaacagaaataagaagaaaacaggtgaaaaagacagtgtgataaggccatggtggtggattgtggatgccctgccc

SEQ ID NO: 202277 - DNA, 612 bp, Homo sapiens
  Payload ID: 19900
  Gene Name: zinc finger protein 365
  ENST ID: ENST00000373784
  CDS Start-End: 154-351
ctgggtcaaagggtgaagtagaaggaagctggaaacacatagtattttagaagtttttcagagaaatcacaaggcaggaacttctgctcagtttggaagaaagagcattccatcatgacccttggactgggtgagagcatcatcctttaattaatgtctgcgctgggtcagataaccatcactgtctccaggtgctggaatacagagaggaaccaaacagataaaaatccttgcctgcacggagcttaccttcagctaagggagacagtcaaaaacaaggatttagccaaatttgggtgctatttcccttttgtggagggacttttcatcacaatgagaaggacgtcttaggactccaggactttgagagagaaagtgtctctacaagtcaaagcaggaatatcagccttcttacactaggacaactccaaaattgtgtgattggcaaattgacaatcatcgatttgttgactgaacacctgttaggtgtaaggcacggtgtcatatgctttccttggggcttgccttcaagcagctaacagaaataagaagaaaacaggtgaaaaagacagtgtgataaggccatggtggtggattgtggatgccctgccc

SEQ ID NO: 202278 - DNA, 433 bp, Homo sapiens
  Payload ID: 19900
  Gene Name: zinc finger protein 365
  ENST ID: ENST00000395249
  CDS Start-End: 154-360
ctgggtcaaagggtgaagtagaaggaagctggaaacacatagtattttagaagtttttcagagaaatcacaaggcaggaacttctgctcagtttggaagaaagagcattccatcatgacccttggactgggtgagagcatcatcctttaattaatgtctgcgctgggtcagataaccatcactgtctccagagaaagtgtctctacaagtcaaagcaggaatatcagccttcttacactaggacaactccaaaattgtgtgattggcaaattgacaatcatcgatttgttgactgaacacctgttaggtgtaaggcacggtgtcatatgctttccttggggcttgccttcaagcagctaacagaaataagaagaaaacaggtgaaaaagacagtgtgataaggccatggtggtggattgtggatgccctgccc

SEQ ID NO: 202279 - DNA, 2695 bp, Homo sapiens
  Payload ID: 19900
  Gene Name: zinc finger protein 365
  Uniprot ID: Q70YC4
  ENST ID: ENST00000395251
  CDS Start-End: 335-985
gaagaggaagagagacccgagctagcacactcagtccccttgctatgtgatgttctttaccatctcaggactctgcacagagtccccaacagcaagaaggccctcaccagatacagccccttgacctgggacttctcagcctccataaccgaattggcccctacaagtcaagttgcaaaccctgggtcaaagggtgaagtagaaggaagctggaaacacatagtattttagaagtttttcagagaaatcacaaggcaggaacttctgctcagtttggaagaaagagcattccatcatgacccttggactgggtgagagcatcatcctttaattaatgtctgcgctgggtcagataaccatcactgtctccaggtgctggaatacagagaggaaccaaacagataaaaatccttgcctgcacggagcttaccttcagctaagggagacagtcaaaaacaagtcaacacatctaaagaagccactgatgaaacaggctcccccttggaaagaccatctcaccttccaacctctccatcctgcagagaggaaaacccaagtttggcgttggcagtcaggtaattcatcagatctggaaaccacctcatcagcatccccctggccaactggaagcaaccgtgacgttgtgctgaatacacttgcagagtcgtgctgtggtctctccgagctcatcacggcacctccctatgcaggagtttcaattcaaggatttagccaaatttgggtgctatttcccttttgtggagggacttttcatcacaatgagaaggacgtcttaggactccaggactttgagagagaaagtgtctctacaagtcaaagcaggaatatcagccttcttacactaggacaactccaaaattgtgtgattggcaaattgacaatcatcgatttgttgactgaacacctgttaggtgtaaggcacggtgtcatatgctttccttggggcttgccttcaagcagctaacagaaataagaagaaaacaggtgaaaaagacagtgtgataaggccatggtggtggattgtggatgccctgccctgtatccacttgggagagagcctctacaacatgctggcaacttccccctcactgattcaaatgttaatctcctttggcaacaccctcacagacacacccaggatcaatacgttgtatcctttgatccaatcaagttgccactcagtattaaccatgacaccttctaagccatcatctcctcctaatcctcccataacaatgggtataagttatgaaggtgggttagaaactagtgcctatccctcactaagttgccagatggatttaacagcacctcaaagtcaacatgccccaagtcaaagtcttctttacccatggaataagctggcttgctacttccctacatctctgaagggctccaccattcctctagcaaccatgctctcaaagctcagagggaggaaaaggaaatggatctaaatggaattccaggtcccacgctggatattttcacaccttacctcatttaatacaacaagcaaggaggtagacaatattgtctacctttgcaaatgaggaaacagaggcttagagaagttaaataatttgcctgagaataaagctaaaagtagctttaaaatactagagctgggattgcaagtttgatgcaaagtttgtgctctcttcatccttcaccaagatctttcattttccctttaaatatctcttatgtctgcatttcccttccattcccatcactagcactgtcctctaatgccccacccagtggggaagtctccaataggtccccctgcttataacagccaagagggtagctataaactaggtccaataacatgcttcatgtgagggaactgatggacagctgtctaattcataacctctggcctcaacggaatttacagttcagagtccaaaatagcaaggaagtggtgggaagaaggtgagagaaaagggtgggagggtgagagaggggagggaggggaataaggtgtgggcagtagagggaatctgtcagtctcatggtttgccctaggaaaccttctgctcagccccagcctgcttctgggcactcctcctcacccctccttgctgtccatatgggttcaatgtgagtaaccacaattgtagagtgtggccatcttcttctgacatggtcctaaataaacctaactgagtagccagaagaatcacttctaaggtaaacatctgtaaacattggttatatttattttcaatattactggttaacattgtggagctattactgatgggccagactctgtgctaggcacagactttctagggattatttcatttaattctcatggcaaccaccatgcatttgcagataggcaagtcaggctcacaaaaatgtatgcagagcttcagggttgtgatgggtagagccaaacccatctgcccaacccaagggcccgtgcgctccaaccctgcatcgaactgccaacatagtacaccttttagaaaaagattcttgttgcaaaagtaccataggcagtgtgtgtgtaaggtcattgtaaaagtgtagataagcaagaaagtgttataccaccactcagaagtaaccactgttaacatgttggcttatctgctctcaggtgtttctgtgcctgtacatactattcttcttgaataaaaacaggattacacagtgt

SEQ ID NO: 202280 - DNA, 4173 bp, Homo sapiens
  Payload ID: 19900
  Gene Name: zinc finger protein 365
  Uniprot ID: Q70YC5
  ENST ID: ENST00000395254
  CDS Start-End: 281-1504
gttccccgcggaggtggcagccctgggccgcggcgttccggaacccccgcacccacggcgcggtgccccacggtgcccgcgagcgccgcccccgctggctagccgcgcctcgctccgccctggacgccgccggtcccggcgcggaggtgcggcggggagtgggagccggcccggctcagtctgatttacggctctgctgaaaaccgcttcgctcccgcagcatcagcaccggaggcggcggctgcagcagcagcagcaacaagtcgggacttttagagtaatgcaacagaaggcttttgaggaaagcagatatccctggcaggagtcctttgagaatgttgctgtgtgcctgccattacgctgcccgaggtgtggagaccataccagatttagaagcttgtcatccttgagggcccatctggagttcagtcacagctacgaagaaagaaccctcttgacaaaatgcagtctctttccatccctcaaagacacagacctagtcacttcctcagaactcctgaaaccgggaaaattgcagagcagtggcaacgtggtaaagcagaaaccgagctatgttaacttgtacagcatttcacatgaacattccaaggacaggaagccatttgaggtggtggcagagaggcctgtgtcctatgtgcagacctacactgccatggacctccatgcagactcgctggatgggacacggtcgggtcctggactgcccacctcagacaccaaagcttctttcgaggcacatgtcagagaaaaattcaatcgaatggttgaggctgtggataggaccattgagaagagaattgataaactcaccaaagagttggcccagaaaactgcggaactgttggaagttcgggcagcttttgtgcagctgactcagaaaaagcaggaagttcagagacgagagcgggccttaaacagacaggtggacgtggccgtggaaatgatagctgtactgaggcaacgcctgacggaatctgaggaggagcttcttaggaaagaagaagaagttgtcacattcaaccatttcctggaagcggcagctgagaaggaggttcaagggaaagcccggctccaggactttattgagaatctgttacagcgggtagaactggcggagaagcagcttgagtactatcagagccagcaggcctctggctttgtccgtgatctcagcgggcacgtgcttacagacatctcctcaaataggaagcccaaatgcctaagccgagggcacccgcattcggtatgtaaccaccctgatctcaaggcccatttccacccaaagggaaggaaccacctgaaaaaggccaaggatgacagagccagcatgcagcctgccaaggccattcacgaacaggctgagtcctcaagagacctctgcagacctccaaagaaaggggagctcctggggtttggccgcaaaggcaacatcaggcccaaaatggctaaaaaaaagccaacagccattgtgaacatcatctaaaagggtgggtggtgctggaccaatcatcgctgggctttggggaacgttgttccaggagccaacagtaatgtctttctggaaacattccatagtaagacacattggaaaagccaagggcataacacaggcaagcacctcaattaaccagagcttagcaaatgggaatcttagtgaaccagaattttattataacccccttttagaagcttgcaaattacagaaagaataaaaaaattaaatcaatcttaaagctctaacttctaaagtaactggcccagtctccagtaatcttggcatctgggcttctatgcagtggtcactaattttcaggaccaaggccacacaaaatgtcaggcctagggagaaaattcatctgtgcccactgctctccaaagtgcgaggcaaggaatggcagtgtaaagttctgttaatagcagtaaaatgaaaatatttgtgtttgtgtataaccttcccctcagctaatttgaaagcctccaaaataaggattcccattccccgagtattctggttaatcaagatttcaatttctgggttgctcaagggactcgttcagtcagacttcagttctcattccgacagggtgtctttcagttcgtttgtttgattgaggttttttggtggcctagatgcatgtttattcagattttggtacacctctgccgtcttctttggctgagtattctgcacccacagaccatgctgccagcctctatcttaatagctgcttctgtggatatggctggggagcgaagtaaaatcctcttttgattagcacccagcatgggctgggtggctaggtggttggaatgacagtggactgcacgcttggtgcatcgtgcatcgtgaccatcctggaagcactgcgggtgtcgccaagccctttcctaagacctgcttcccggccagtgtcagtggccctctctctctctgctatgggcatgactttctcttcgctggcttaacttttccactgggtggttcactttgcctcctgctgcttctgtgccctgttaagggcttcaggtatctttcaaccaagtatctggagtgttcactctatgttgcattctaaagtaatttctgaaataaacaatgcatgtaggagccagaatctgacactgtcttcccctccttccctccctaaaatggctttagtttccacaaagagctgttaagaatttcctgctgtatgattttcctcaagaatgaatttccatgttattttttccttaaatttagcaatatcatcaggtctcttgcagagtttacaagtgctgacattcttctgaaaacaggaataattttgtccacaaatatatacatatatacatatatataacacatacaaaatatatatgttaagtatattaataatttatttttaaatactcatggagaaagtgtgtgtttgtggtgggtggtttttaaactatatatgtttgttcatgtaaactgaattctcttatttaaaaaatcaaaactgtaacgtaattaacattggcagaattatgattgttactgcaataagcatcaaattagcagcgcattaaaaataggaaataaagcagttgcttaaaatgccagtcaattgaaaagtgtaacttatcattatacaaacattctgaacctaccataatgaaaatgttcttgaatcttcactttgactttcagtttatggggggggtagatcattcatgtgatatataagcagctatcaagtgggcaaaaacattgctgtgaatagcactgtttaggctaacattgtaaaaattgtaatgttataattattatttatttggagaattaacttccccctctaaagttatttattattgatgcttataccatgattgcaccttagccttttacatactaaaaacatgacttgttagttgtattgcatgctctttgtcctgtaatgtgtgtgcaatgacaacttgtttctgttttatttaaagtaactgacattttggattttcatctaacatagagggcatggcaactctctttgacagtggtaccccatgatcttcagaaagtaccataatgtcatcctactctacatttcacaagacgaattattttgagatttgtttattatattaaaatgtttttttacgttcccactaaattttgaccccatataaagaaatgtgttatgtatgttgtgcctccttagagacataaatttagtgtcaaaacatgggagatggcttactcagaagcatactccacttaacataccatggcctgagctaagtaccatgtcctgtttgtgtcttatttttaaatattttctttgtccacatgggccgttgaccttagagttaaggcggttgcttttttgaagaaatcaccaaagtttctgggaaactatgttcaaggttgaaatggagagtagatttaattttatttgtcttgtagggaagaaatcttcctttgaaccgcttttcttgctttttccctttttcccaaactaggttacaggttcttatctgcaaggttcaagttgcttagacattgttttccagtattctgcagggccagtcagttgtacagaagttggaatattctgttccagaattaaagaagtttttagattatgaaatattatgataataaagctatatttctgactaatgtgttga

SEQ ID NO: 202281 - DNA, 1674 bp, Homo sapiens
  Payload ID: 19900
  Gene Name: zinc finger protein 365
  Uniprot ID: Q70YC5
  ENST ID: ENST00000395255
  CDS Start-End: 281-1282
gttccccgcggaggtggcagccctgggccgcggcgttccggaacccccgcacccacggcgcggtgccccacggtgcccgcgagcgccgcccccgctggctagccgcgcctcgctccgccctggacgccgccggtcccggcgcggaggtgcggcggggagtgggagccggcccggctcagtctgatttacggctctgctgaaaaccgcttcgctcccgcagcatcagcaccggaggcggcggctgcagcagcagcagcaacaagtcgggacttttagagtaatgcaacagaaggcttttgaggaaagcagatatccctggcaggagtcctttgagaatgttgctgtgtgcctgccattacgctgcccgaggtgtggagaccataccagatttagaagcttgtcatccttgagggcccatctggagttcagtcacagctacgaagaaagaaccctcttgacaaaatgcagtctctttccatccctcaaagacacagacctagtcacttcctcagaactcctgaaaccgggaaaattgcagagcagtggcaacgtggtaaagcagaaaccgagctatgttaacttgtacagcatttcacatgaacattccaaggacaggaagccatttgaggtggtggcagagaggcctgtgtcctatgtgcagacctacactgccatggacctccatgcagactcgctggatgggacacggtcgggtcctggactgcccacctcagacaccaaagcttctttcgaggcacatgtcagagaaaaattcaatcgaatggttgaggctgtggataggaccattgagaagagaattgataaactcaccaaagagttggcccagaaaactgcggaactgttggaagttcgggcagcttttgtgcagctgactcagaaaaagcaggaagttcagagacgagagcgggccttaaacagacaggtggacgtggccgtggaaatgatagctgtactgaggcaacgcctgacggaatctgaggaggagcttcttaggaaagaagaagaagttgtcacattcaaccatttcctggaagcggcagctgagaaggaggttcaagggaaagcccggctccaggactttattgagaatctgttacagcgggtagaactggcggagaagcagcttgagtactatcagagccagcaggcctctggctttgtccgtgatctcagcgggcacgtgagctggaaaggtgctggcgaagctcgcctggtgtgccaaaatgacctggaattggaggagtctgcgattgtggaataatgaacttcgaatgatgtgattctggatgaggacttggatcaagagaatcgcaaattaattgtgccagagaagctttcattcattcaacaaatatttattaagcatgttttacactccaggaactttacaagaaacttgggctacttggtgactttactcaccaggagtgggttcagactcctgatggatgagctccaggtcctccctaacaagactgcagacttcctgagggcacagcccacccctcatgctttgagtttctcatataacccatcatagcaagtagaagatgcttcagaacatttgtccctatgagatagagtcatattctatttagcttgggacatggcaggtactcagttgttaaataaaaaatagttattgagtaattt

SEQ ID NO: 202282 - DNA, 3379 bp, Homo sapiens
  Payload ID: 19900
  Gene Name: zinc finger protein 365
  Uniprot ID: Q70YC5
  ENST ID: ENST00000410046
  CDS Start-End: 281-1669
gttccccgcggaggtggcagccctgggccgcggcgttccggaacccccgcacccacggcgcggtgccccacggtgcccgcgagcgccgcccccgctggctagccgcgcctcgctccgccctggacgccgccggtcccggcgcggaggtgcggcggggagtgggagccggcccggctcagtctgatttacggctctgctgaaaaccgcttcgctcccgcagcatcagcaccggaggcggcggctgcagcagcagcagcaacaagtcgggacttttagagtaatgcaacagaaggcttttgaggaaagcagatatccctggcaggagtcctttgagaatgttgctgtgtgcctgccattacgctgcccgaggtgtggagaccataccagatttagaagcttgtcatccttgagggcccatctggagttcagtcacagctacgaagaaagaaccctcttgacaaaatgcagtctctttccatccctcaaagacacagacctagtcacttcctcagaactcctgaaaccgggaaaattgcagagcagtggcaacgtggtaaagcagaaaccgagctatgttaacttgtacagcatttcacatgaacattccaaggacaggaagccatttgaggtggtggcagagaggcctgtgtcctatgtgcagacctacactgccatggacctccatgcagactcgctggatgggacacggtcgggtcctggactgcccacctcagacaccaaagcttctttcgaggcacatgtcagagaaaaattcaatcgaatggttgaggctgtggataggaccattgagaagagaattgataaactcaccaaagagttggcccagaaaactgcggaactgttggaagttcgggcagcttttgtgcagctgactcagaaaaagcaggaagttcagagacgagagcgggccttaaacagacaggtggacgtggccgtggaaatgatagctgtactgaggcaacgcctgacggaatctgaggaggagcttcttaggaaagaagaagaagttgtcacattcaaccatttcctggaagcggcagctgagaaggaggttcaagggaaagcccggctccaggactttattgagaatctgttacagcgggtagaactggcggagaagcagcttgagtactatcagagccagcaggcctctggctttgtccgtgatctcagcgggcacgtgagctggaaaggtgctggcgaagctcgcctggtgtgccaaaatgacctggaattggagatttttggccatataaaccaccatctttcggggttgaaagattctcattgtctagtttttctgcaagccccacctgtgccctggatcattttagccagctttctctggattctcggaaatccctggacgtcttccacggctactgcaggatttagccaaatttgggtgctatttcccttttgtggagggacttttcatcacaatgagaaggacgtcttaggactccaggactttgagagagaaagtgtctctacaagtcaaagcaggaatatcagccttcttacactaggacaactccaaaattgtgtgattggcaaattgacaatcatcgatttgttgactgaacacctgttaggtgtaaggcacggtgtcatatgctttccttggggcttgccttcaagcagctaacagaaataagaagaaaacaggtgaaaaagacagtgtgataaggccatggtggtggattgtggatgccctgccctgtatccacttgggagagagcctctacaacatgctggcaacttccccctcactgattcaaatgttaatctcctttggcaacaccctcacagacacacccaggatcaatacgttgtatcctttgatccaatcaagttgccactcagtattaaccatgacaccttctaagccatcatctcctcctaatcctcccataacaatgggtataagttatgaaggtgggttagaaactagtgcctatccctcactaagttgccagatggatttaacagcacctcaaagtcaacatgccccaagtcaaagtcttctttacccatggaataagctggcttgctacttccctacatctctgaagggctccaccattcctctagcaaccatgctctcaaagctcagagggaggaaaaggaaatggatctaaatggaattccaggtcccacgctggatattttcacaccttacctcatttaatacaacaagcaaggaggtagacaatattgtctacctttgcaaatgaggaaacagaggcttagagaagttaaataatttgcctgagaataaagctaaaagtagctttaaaatactagagctgggattgcaagtttgatgcaaagtttgtgctctcttcatccttcaccaagatctttcattttccctttaaatatctcttatgtctgcatttcccttccattcccatcactagcactgtcctctaatgccccacccagtggggaagtctccaataggtccccctgcttataacagccaagagggtagctataaactaggtccaataacatgcttcatgtgagggaactgatggacagctgtctaattcataacctctggcctcaacggaatttacagttcagagtccaaaatagcaaggaagtggtgggaagaaggtgagagaaaagggtgggagggtgagagaggggagggaggggaataaggtgtgggcagtagagggaatctgtcagtctcatggtttgccctaggaaaccttctgctcagccccagcctgcttctgggcactcctcctcacccctccttgctgtccatatgggttcaatgtgagtaaccacaattgtagagtgtggccatcttcttctgacatggtcctaaataaacctaactgagtagccagaagaatcacttctaaggtaaacatctgtaaacattggttatatttattttcaatattactggttaacattgtggagctattactgatgggccagactctgtgctaggcacagactttctagggattatttcatttaattctcatggcaaccaccatgcatttgcagataggcaagtcaggctcacaaaaatgtatgcagagcttcagggttgtgatgggtagagccaaacccatctgcccaacccaagggcccgtgcgctccaaccctgcatcgaactgccaacatagtacaccttttagaaaaagattcttgttgcaaaagtaccataggcagtgtgtgtgtaaggtcattgtaaaagtgtagataagcaagaaagtgttataccaccactcagaagtaaccactgttaacatgttggcttatctgctctcaggtgtttctgtgcctgtacatactattcttcttgaataaaaacaggattacacagtgt

SEQ ID NO: 202283 - DNA, 489 bp, Homo sapiens
  Payload ID: 19900
  Gene Name: zinc finger protein 365
  ENST ID: ENST00000421210
  CDS Start-End: 331-489
ttgcaggcttaatgccactgtgcatagcttgagtaatctttcctgtacttgaggataggtcctgagcttgctgtcttaggacccattttgacaattcatgtgagttttcatatgttcttgtgttcacgcatctcggattgtatccttaaaatggggcacggttttgcatttagtgtgccaaattcaggaggggaggaaacttgaattccacttctggatctaccactttccatctgaccttggattaatggctttacttccttgcttcagtgttctcttctgtggagagggaatgttacccacctttttgattctaggacttttagagtaatgcaacagaaggcttttgaggaaagcagatatccctggcaggagtcctttgagaatgttgctgtgtgcctgccattacgctgcccgaggtgtggagaccataccagatttagaagcttgtcatccttgagggcccatctggagttcagtcacagctac

SEQ ID NO: 202284 - DNA, 877 bp, Homo sapiens
  Payload ID: 19900
  Gene Name: zinc finger protein 365
  Uniprot ID: Q70YC4
  ENST ID: ENST00000614806
  CDS Start-End: 154-804
ctgggtcaaagggtgaagtagaaggaagctggaaacacatagtattttagaagtttttcagagaaatcacaaggcaggaacttctgctcagtttggaagaaagagcattccatcatgacccttggactgggtgagagcatcatcctttaattaatgtctgcgctgggtcagataaccatcactgtctccaggtgctggaatacagagaggaaccaaacagataaaaatccttgcctgcacggagcttaccttcagctaagggagacagtcaaaaacaagtcaacacatctaaagaagccactgatgaaacaggctcccccttggaaagaccatctcaccttccaacctctccatcctgcagagaggaaaacccaagtttggcgttggcagtcaggtaattcatcagatctggaaaccacctcatcagcatccccctggccaactggaagcaaccgtgacgttgtgctgaatacacttgcagagtcgtgctgtggtctctccgagctcatcacggcacctccctatgcaggagtttcaattcaaggatttagccaaatttgggtgctatttcccttttgtggagggacttttcatcacaatgagaaggacgtcttaggactccaggactttgagagagaaagtgtctctacaagtcaaagcaggaatatcagccttcttacactaggacaactccaaaattgtgtgattggcaaattgacaatcatcgatttgttgactgaacacctgttaggtgtaaggcacggtgtcatatgctttccttggggcttgccttcaagcagctaacagaaataagaagaaaacaggtgaaaaagacagtgtgataaggccatggtggtggattgtggatgccctgccc

SEQ ID NO: 202285 - DNA, 3830 bp, Homo sapiens
  Payload ID: 19901
  Gene Name: zinc finger protein 366
  Uniprot ID: Q8N895
  ENST ID: ENST00000318442
  CDS Start-End: 492-2726
ataccagaggctgcaggctcaggagagcctgcctgtctggaacaccgtttgtttggacaggacaggccactaaggcgtttcatctctttaaagctcccagggcagagaacatatttgaggaattccttttttcaaagattttttttttttgccccttccaacattttgtttaagagaaaatgagatgtctatcttctgtttccttattttttttcaggaaagcaaagggttgttgacttcctccctctcccctcccttccttccttcttcccgaaggtactcatctgagaaaaagagaacgaagtattgttcctgttctctttcttaagtcattcgaaacactgtccctgcgagttctttaagttccctgcaatctgtacacaagagaaagagggagagagagagggagagagacagagagagcagggatcaggtaaaggagtggggctgctgcagccattcagacctcaggagctggaaaattgccaaggatgcagaaggaaatgaagatgatcaaagacgaggatgtgcatttcgacttggctgtgaagaagaccccctcctttccccactgcctgcagccagtggcttctcggggaaaggctccccaaagacaccccttcccggaagctctccgagggccattttcccagtttcggtatgaacctcccccaggagacctagatgggttccccggggtcttcgaaggagcagggtctaggaaacggaagagcatgcccacaaagatgccctataaccaccctgcagaagaagtcaccctcgccctccactcagaggagaacaaaaaccacggccttcccaacctccctttgctgttcccgcagcccccgcgccccaagtatgactctcagatgatcgacctgtgcaacgtgggcttccaattctaccgcagcctggaacactttgggggcaagcccgtcaagcaggaacccattaagcccagcgccgtgtggccccagccaacgcccactccattcctgcccacgccctacccctactaccccaaagtccacccgggcctcatgttccccttcttcgtgccctcgtcctcgcccttccccttcagccggcacaccttcctgcccaagcagcccccggaacctctgctgccccggaaagccgagccccaggagagcgaggagaccaagcagaaggtggagagggtggacgtgaacgtgcagatcgatgacagctactacgtggacgtgggcggctcgcagaagcgctggcagtgccccacctgcgagaagtcctacacctccaagtacaacctggtcacccacatcctgggccacagtgggatcaagccgcacgcgtgcacgcactgcgggaagctcttcaagcagctcagccacctgcatacccacatgctgacccaccagggcacgcggccccacaagtgccaggtgtgccacaaggccttcacccagaccagccacctgaagcgccacatgatgcagcacagcgaggtgaagccgcacaactgccgcgtgtgcggccgcggctttgcctaccccagcgagctcaaggcccacgaagccaagcacgccagtgggcgcgagaacatctgtgtggagtgcggcctcgacttccccaccttggcccagctgaagagacacctcaccacgcaccggggccccatccagtacaactgctccgagtgcgacaagaccttccagtacccgagccagctgcagaaccacatgatgaagcacaaggacatccggccctacatctgctcagagtgtggcatggagtttgtgcagccgcaccacctcaagcagcactccctcacccacaagggtgtgaaggagcataagtgtgggatttgtgggcgggagttcaccctgctggccaacatgaagcgacacgtgctgatccacaccaacatccgcgcctaccagtgtcacctctgctacaagagcttcgtgcagaagcagaccctcaaggcacacatgatcgtccactctgacgtgaagcctttcaaatgcaagctttgtgggaaggaattcaaccggatgcacaacctgatgggccacatgcacctgcactcagacagcaaacccttcaagtgcctctattgcccaagcaaattcaccctgaaggggaacctgacacgccacatgaaagtcaagcatggagtcatggagcggggccttcattcccaaggtctgggaagggggagaatcgccctggcacagacagccggtgtcctgaggagtctggagcaggaggagccctttgacctctctcagaagcgccgggccaaggtgccggtgttccagtcagacggggagagtgcccagggcagccactgccacgaggaggaagaggaggataactgctacgaggtggagccctacagccctggcctggccccccagagccagcagctctgcacacccgaggatctgtccaccaagtcggagcacgcccccgaggtgctggaggaagcctgcaaggaggagaaggaggatgcatccaagggagaatgggagaagaggagcaagggtgaccttggggcagagggcggccaggagagagactgtgccggcagagatgagtgtctcagtctcagggcttttcagagtacccggcggggcccctctttttctgattacttatacttcaagcacagagatgagagtttgaaagaattactggagaggaaaatggaaaaacaagcagtgcttttaggtatctaagtggacagttttaaaattacatttggaaaatgagaaggaggcagttcaaatatagctttctgcatgaactgtcattttctggagactggcgaatagtaccaatctctacaaatggcttagactaaatgagcagggatgtaggtaatggaaagccttctcaggtcattcacggggcccttgatacccttcacacatgtgcagggtcttcatcagtggcgttttatgcattgccagtataataaactgtgagtattcttccagatatctaattgtaagctgatgctgaggtgcttttagaaattctactttcctttgattcatatgcaatacatggtaaatttctaattgcaaaaatatggtgcttgaggtgtcaccttattaataactatttaggtgaatttgtgaaggttataatattttccatatagatgaaaatattagtcgtcatatatataaaaatagcctttattctataaccaaaaatgtcagaaatggcacaggaggatgagctattgaagagaatgctctccagtagttgctgcagatataaggtaaaatttcaggagaagaataattttgactaagggaaactggtgacctagaatacttagattctcttgttctgtgtcggctgtcttcatcagattgagcatttggagcattatttttcagatgatatgatgatgtttggggccctggctcctcagacaaaccctcacttctcgagcacggctccctcctggagaccattgctgtcttgctctgaggcctcatgccccataagacagatgcaggggccgggcgcagaggctcacgcctgtaatcccagcactttgggaggccgaggcaggcagatcacttgaggtcaggagtttgagaccaacctggccaacgtggcaaaaccccttctctactaaaaatacaaaaattagccaggcatgatggcaggagcctgtagttccagctactcgggaggctgaagcaggagaatcgtttgaacccaggcagtggagattgcagtgagctgagctgagatcacgctactgcactacagcctgggtgacagagtgagactctgcctcaaaaaaaaaaaaaaaaaaaaaa

SEQ ID NO: 202286 - DNA, 494 bp, Homo sapiens
  Payload ID: 19901
  Gene Name: zinc finger protein 366
  ENST ID: ENST00000414109
  CDS Start-End: 303-494
cgaaacactgtccctgcgagttctttaagttccctgcaatctgtacacaagagaaagagggagagagagagggagagagacagagagagcagggatcaggtaaaggagtggggctgctgcagccattcagacctcaggagctgagatgaggaaactacagctcagacagagtaaaggattcggctgaagtcctatagctccacggatcttcagggaggtccttgatctgagaagtctggaatccgctgaagtagaccaaagctagggctcactaacaagttgcagaaggaaaattgccaaggatgcagaaggaaatgaagatgatcaaagacgaggatgtgcatttcgacttggctgtgaagaagaccccctcctttccccactgcctgcagccagtggcttctcggggaaaggctccccaaagacaccccttcccggaagctctccgagggccattttcccagtttcggtatgaacctcccccaggagaccta

SEQ ID NO: 202287 - DNA, 549 bp, Homo sapiens
  Payload ID: 19901
  Gene Name: zinc finger protein 366
  ENST ID: ENST00000514477
  CDS Start-End: 202-399
agttccctgcaatctgtacacaagagaaagagggagagagagagggagagagacagagagagcagggatcaggtaaaggagtggggctgctgcagccattcagacctcaggagctgagatgaggaaactacagctcagacagagtaaaggattcggctgaagtcctatagctccacggatcttcagggaaaattgccaaggatgcagaaggaaatgaagatgatcaaagacgaggatgtgcatttcgacttggctgtgaagaagaccccctcctttccccactgcctgcagccagtggcttctcggggaaaggctccccaaagacaccccttcccggaagctctccgagggccattttcccagtttcgcccccgcgccccaagtatgactctcagatgatcgacctgtgcaacgtgggcttccaattctaccgcagcctggaacactttgggggcaagcccgtcaagcaggaacccattaagcccagcgccgtgtggccccagccaacgcccactccattcctgcccacgccctacccctactacccca

SEQ ID NO: 202288 - DNA, 3646 bp, Homo sapiens
  Payload ID: 19902
  Gene Name: zinc finger protein 367
  Uniprot ID: Q7RTV3
  ENST ID: ENST00000375256
  CDS Start-End: 298-1350
gcgtcctgctttcctgtcaccgcaagggccgggccgcccgctgcttcccacccctgcagcctgcgctgcggagtacaaagagcggagggcgcgcttgacctggggctggggtccagccctgcccgccggtgccgtctgctcaactagttaggtggctgctgcgcaggattccgggaaacgtcagtctgccatgagccggcaggactgagcctgcgactcggagcagagcgagtgaggggcagagcggtgctcaggagtgcggcccggggccgccggagctgggggtcgggccgggcgatgatccggggcttcgaggcgcccatggcggagaacccgccgccgccgccgccgcccgtcatcttctgccacgactccccgaagcgggtgctggtgtcggtcatcaggacgaccccgatcaagccaacgtgcggcggtggaggggagccggagccgccgccgccgctcatccccaccagccccggcttcagcgacttcatggtgtacccgtggcgctggggcgagaacgcacacaacgtgacgctcagccctggggccgcgggggccgccgcctcggccgccctgcctgcagccgcagccgccgagcactcggggcttcgtggccggggcgcgcccccgcccgccgcctcggcctccgccgccgcctcgggaggtgaggacgaggaggaagcgagcagcccagacagcggccacctcaaggatggaatccgacgtggtaggcccagagcagatactgtccgcgatttaataaatgaaggagagcattcatccagcagaatccgttgtaacatctgtaatagggtgtttccacgggagaaatcgctccaggctcacaaaaggactcatacaggtgagaggccctatctgtgtgactatccagactgtggaaaagcctttgttcaaagtggacagctcaaaacacatcagcgtcttcacaccggagagaaaccttttgtttgttcagaaaatggctgcctgagcagattcacccatgcaaaccgccactgtccgaagcacccctacgccaggctgaagagagaggagcccacggacacactcagcaaacatcaggctgccgacaacaaggccgcggccgagtggctggcgaggtattgggaaatgagagagcagcgcacccccactttgaaaggcaagctggttcagaaggctgatcaggagcagcaggaccctctggaataccttcagtctgatgaagaggacgacgagaagagaggggcccagcgccggctgcaggagcagcgggagcgcctgcatggagccctcgcgctcatagagcttgccaacctgactggggcgccactccgacagtagcttggacactgactcttccactgtacaaaagtactgcccagcatacttaaaaagtagatccttgggcataagctaagcaccttatttgcttatcataggctgctattctgtagaaatttatgaagaatgttattgccccagaatatggggtgagagagaactgcacttttttaatatggaaatgaattcatcgtaaagtttaaaatattttgtaaatatggactgcacagtacagggtagaaaactacatattgtgggaagctagattttgcaagtttaatgcattcattggaagcagttctcacaggaagcactttctgaataagacacttgtttgaaaaacagaatggtacaaatagccaaagaagattaaaacagattatttataagatcatttttaacaatatatattagtatgtttaacaatactgtaaacactgaagcaagcaagaaagtataaaatatgtaagatagataattttaattgcaaaatactgtgcccactaaggctagagaaatgggaggctattttggaagatgttctaagtaatggacttagaagaaaatagatatttgaggctcttggtaagatgcacaatagttcagaatttttgaaattggagcaaaatcagtcttattctatctggggctttacaactcagtataatgtttaagtttgaaaagcacttgtcatccctagcatgttaacttgggaacttttgcacatttcatatttctcatttgctgaaattgagtgattaatcttgcaaagtctaggtaacatagtaattggtaattttaaaaatacatattaagggccctgtaatgagatttggcacttggatttttactaaagggacacctgcagggttgttttgtagtgaaatgttttagatcttttgttagcaaacactacattttaattgtactgcttgtttagaattattagcaaatggaagcctccatatttatattttcagtgcataaagccaccttcttgctttacttcagagtaacatgccaagctattttgtgttcactaaatttagctatcagttaaacactgcagaaaatattagctactcaaataagtaggcttctgaaatagttttaactgcaagtgtgttaacttgtgtggtggtttgaagccatttttccaaataaagttattaaacaccactttatgtactgaagcatgaacagaaaaatcaagagctgagcagaccacctcctttatgtaggcaaaacttccatcattttggcttttgttctaaacagaactaaatgacatgcatagcatggtaacttacagatcgcttaattggagtaaaactcagagtaatagagggaaatatgggctcttcagtgcctttttagcttttttgagttgaagacgttcctacagatgtagtttaaacattacaaagtaggcttctttatccaaaaatcccaatgtgtcatagtacacagatagtttaaaatatgtagccacggggaaggggaggcatgtaaatgtcttgaagaggagaaaaagtatgaaagaagatacgatagttacgaataatgtgtatgatgaggacatactttaaaaatgtaattcctctgtacagtaaattacaaatctttagggatttttttgtaataagagaatttatatttgtaatggtctaagaatttttttgtaatgtggtatatagaattttaatttggagcacttataagctggtaagagagactatagcatctgaattatcttggtttatgtttcagcatttcctctagaatttttgctctcaaatatgtgatttaatgaactaaaaacaacactcatcagtcttgggaaatttgaactttgatcaacttaactaaagaaggaagggtagtaagaatttttcaaatacaaatatttgccaattcacagatgataacatttaaggccttcaaaagtaagggtttttccttgtttctccagtcagcttttgtcaactctaatagttttttcataaacattttttatttgtataattgcaacagtttaagaaattatcacaactatttagaaacatttaaaatgttctttttgatataagctatatacttggaaaaatacattggtatctaaaatttgaggtgtgttaagactgctttttgttttaaaaaatggtttacattcaaatttttgaagtgttttatgcttcatatggctaagttgtagtttggcagagttaacagcataagaataaacatgctgtaattttaaaagatgctttgaataaaaatttattttaatttaaaa

SEQ ID NO: 202289 - DNA, 7027 bp, Homo sapiens
  Payload ID: 19903
  Gene Name: zinc finger protein 37A
  Uniprot ID: P17032
  ENST ID: ENST00000351773
  CDS Start-End: 831-2516
ggagatgtagtgtgcacttttcggcccccgtcgcgggagccgcttcgggccttctgggcatgtctgccatatggctccaggtttgtttttctccccggcactctgacggggagggctcccggcatctcctggcgtccgggtagaggacgcggagggtcgcagcttcattgcctgatgtcttcgggaagtattttgaagtcatcgtggctgtggattggggaatttcttgtttccactgacctgtgaggccgcgcacgcggagggaggcaccccaggccctccggcactgtccagcctcgcctgtgtccccattagcaccagtgggcattttcagagggtccagctcatggctcaagtgacaggaagatgtaggagctttctgtcttgaatgaggattcgaaccaaagggcttaggcccagctgtcttggagcaaagcagctgttgtgggacccccacaggctgggagctttgtgcccattcagatgtgggggcagaagagggcaaggccgaaggagcagacagcaccgcttcttggggagttgtgaaggcatcatgcggagggaagagcttagcagccaagtggaggacagcaccctccatgcctggattcgttactcgctcgttctagatgctgagctgctggcgcactgcagcacaactagagatgtacggatgcccccatcttgatcttacagaatcagaggtacagccgcgagaaaggtctagtcaagaacagacagagtcgcttgaggactcaggagggtgtttgctgcgttgacaacagactacaccctcacagtttgctctgctcttccaacaccagtggaagatgatcacatcccagggatcagtgtcgtttagggatgtgactgtgggcttcactcaagaggagtggcagcatctggaccctgctcagaggaccctgtacagggatgtgatgctggagaactacagccaccttgtctcagtagggtattgcattcctaaaccagaagtgattctcaagttggagaaaggcgaggagccatggatattagaggaaaaatttccaagccagagtcatctggaattaattaataccagtagaaactattcaataatgaagttcaatgagtttaacaaaggtggaaaatgtttctgtgatgaaaagcatgaaataattcattctgaagaggaaccttctgaatataataaaaatgggaacagcttctggctgaatgaagacctcatttggcatcagaaaattaaaaattgggaacaatcttttgaatacaatgaatgtgggaaagctttccctgagaattcactcttccttgtacataagagaggttacacaggacagaaaacctgcaaatatactgaacatgggaaaacctgtgatatgtcatttttcatcactcatcagcaaacacatccaagagaaaaccactatggtaatgaatgtggagaaaatatctttgaggaatccattctccttgaacatcagagtgtttacccattcagccagaagttaaatctcactccaattcagagaacccactcaattaacaatattattgaatataatgagtgtggaacatttttcagtgaaaaattagtccttcatttacaacagagaacacatacaggagaaaaaccttatgaatgtcatgaatgtggaaaaaccttcacccagaagtcagcccacacaagacatcagagaacacacacagggggaaaaccctatgaatgtcatgaatgtgggaagaccttctataagaattcagacctcattaaacatcaaagaattcatacaggggagagaccttatggatgtcatgaatgtgggaaatccttcagtgaaaagtcaacccttactcaacatcaaagaacgcacacaggggagaaaccatatgaatgtcatgaatgtgggaaaaccttctcatttaagtcagtccttactgtgcatcagaaaacacacacaggggagaagccctatgaatgctatgcatgtgggaaagcctttctcagaaaatcagacctcattaaacatcaaagaatacacacaggtgaaaaaccttatgaatgtaatgaatgtgggaagtcattctctgagaagtcaacccttactaaacatctaagaactcacacaggtgagaaaccttatgaatgtattcagtgtggaaaatttttctgctactactccggtttcacagaacatctgagaagacacacaggggagaaaccttttggatgtaatgaatgtgggaaaaccttccgtcagaagtcagccctaattgttcaccagagaactcatataagacagaaaccctatggatgtaatcaatgtggaaaatcattctgtgtgaagtcaaaactcattgcacatcatagaacacacacaggggagaaaccctatgaatgtaatgtttgtggaaaatcattctatgttaagtcaaaactaactgtacatcagagaatacacttggggagaaaccctataaatgtagtaaacgagggaaattactctgggtgaagtcagaactttgtagaacacagaacataaagggtgagagaaatctgttaatataatgataatgagaacacctttgccctgaagtcagttctcacagtatagaagagaacttaaagagggaaaaaacaatatgaagatagggaatgcaggaaaacattattctggaatttggaccatacactatgttacaaaactaaaagtggaaaaaacttattggtgaatgaatataggaaacattttgcccaatgccactcttcattaaacatcagagaattcacacggggtgaaacctgggtcagcatccctaggttgagaagggatgcatttttctgctactactacagtttcacagaatacctgagaagacacacttggagaaaccttttgggtgtaatgaatgtgggaaaacctttcatcagaagtcagctctaattgttcaccacagaactcatataagacagaaaccctatgggtgtaatgaatgtggaaaatcattctgtgtgaagtcaagaggccagagaaaatgcacaaactgtaggaaactataggaaagcatttactatgaggttatattttatggagtatatgtaataagaagtagcttctcagtgaacatcagatagtagagaaagtatttttaactgtatccaatgtgtggatgttttaagttaaaatctaaatttaatatagaacagaggtgttgagttgcaggatatctagcaatttaagaaaatgtggaaaaaatatttttattgagaaatagcattttactttgttaatatctagtttagttcattgtcaagactgctattttctaagagacttctaaagacgccactcaagccaatggctataagtagttcaaaggtttattgcttagccatatgaaaaataagggaagattttttagcaaggggacccacaaacaagagtgctcttgtatgtccagaagaaagagaaagaccatcaatcaggggccatagtacaggagcccaccagcaggatttttgaataatcctagggcagactaaattcagacgacccatctcagaatggtggatcaaagcagcaagtcaatttgccttgtatgcaacttatgaggattagtagaagagagtgggtccagatttctggtggtttctgccctgcagatgtctaacacataagccaggacattctgctgtgagtgacttattgtacccaactctatttctctccatactgaaacatgtctttcataggtgatacaactttttaaaatgtatgtgtagatataacttaaatatggagctttcaaaaagcacaaataggctggacatggtggctcatgcctgtaatcccagtactttgggaggctgaggtgggcaaatcacctgaggtcaggagttccagaccagcctggccaacatgatgaaaccctgtctctactaaaaatacaaaaattagccgggcatggtggtgcacatcggtagtcctggctactagagaggttgaggtgggaggatcacttgaacctgggaggtgggggtttcagtgagctgagatcatgccactgcactccagcctgagtgacagagagagattcaaaaaacaaaaaaaaagcaaaaatatactttgctattgggtaaggtatagtagttggcagcagaatggacccattgaggataactataaaattacagaaaatatttaaatgcaacttattgctatagaagcaaagaggactaaagggcaaaattctagagagtggtaaatctcagaaagcacaagcataaaatgcagctctgggggccctttccacttctggctatagggaagaacctgaatactgaacttgattcaggcagaggaccataacctgggggtcaggggaaggcatgggggggaccagaaaccagaagaacaatcaagactgcaatgaaaaaaatggatacattaggagcttcaaacacatataatttctcaagaaatttccagatgtctcatgctgcatagggcaggagcctgaaaagctaatttgagaagataataagtaggatttttgttttgttttgcattttgcagtacaaaggagaaatgattagaacttaggaagtgccagtgggttggtgaacatgccatcagtaaaagccctggaaacaaggtcatactagagattggttgtgccttgtcacaactgcaaacaatacctgagtggagtattcaaaaacttgcttagaaagaaaactctaggaacagatggcttcactgaagttattccaaatatttaagaaataataccaggcttttataaacttttctagaagaaaaaagatggaacttttccaattcagtttttgaggccagtacaaccttgataacaaaacctaaaaaaaaaacaacaaaaaaacccataaagctatagaccaaagtctcatagatttagatgcaaaatcctaaaattgaaaaaaacatctagccatatccataaactatatcatcaccaagagatgtttattagggcaatcaaaagatttattattttaaaaaaatcagtgtggacttccattcctctttcttttgattcccccctttgacttttcatgtatctctcctgccttccttccccagagtggaggagttagacttgcctcgtgggatgagaggagttgtggctttgtgtctgctggcaccaagagggctgagggtgaggtgtggaagggacagggggaggagatgggcagcattgttgagagattggtaacactgagcaaataaatatgttgagaatgatgacagcaagatttctccattagagaaggtatttataaaaataggaatgaggagagctagaaaacctggagtgtggcattagaatagaactcatatcttttaaatatataggaacaaataaataaattgttgtgtgtgcacatatgcatatattttgtgttcattctactgagaggacctaaacacaatgacacctcagtaacagtaagcacaccaactgccaagttattagttcctaaatactatccacaaaaaaggggaacagggatgattcctagtcagagattgggagaaatacaagatgagcctgaatcatctcatgtacctgacagtaagaaaatactctggctggtctcagtggctcatgtctgtaattctagcatgttagaaggtcaaggtgggtgggttgcttgagctcaggagtttgagaccagcctgggcaacatggcacaattgtctctacaaaaaatacaaaaattagccaggcatggtggcatgcacctgtagtccgaggtactcaggaggcagagacgtgggaggatcgcttgagcctgggagattgaggctgcactgagctgtgatcgtgccactgtactctagcctggaagacagagtgagaccccatctcaggaaaaaagaaaaaaaaaaagatgtcattcagcaggttaatggataaactgtggaacatccagaaaactttaacattcttcaaagaaatagaaaacacaatcctaaaatttatatgggaaccacaaaagacttagaatagtcagctatcctgagcaaaaggaatcaaactggaggaatcatattacctgacttccaattattcaacagagctacagtaaccaaaacagcatgatactggcataacaacagacacataggaacagtatagacaacccagaaacaaattcatacatctatggtgaccacttttgacaaaggaatgaagaacatacactggggaaaagataatgtctttaataaatggtgctgggaaaactggatatccatatgcagaagaatgaaactagacccccatctcttagcatatacaaaaatcaaaattaattaaaaagttaaatctaagacctcaaactatgaaacagctaaaagaaaacatcggggaatctctccaggacattggagtgggcaaagatttcttgtgtaatacctgacaaacaggcaaccaaagcaaaagtggacaaatgggatcacatcaagttaaaaatcttctgcattgcaaaggaaataacaaagtgaagagacaacccatagaatgtgagataatatttgcaaactatccatctgtattaggccatttttgaagtactacaaagaaatacttgagactgagtaatttataaagaagaggtttaattggctcacggttttgcaggctgtacaggaagcatggtgctaacatctgatcagcttgtagggaggcatcaggaagtttccaaccatggtggaaggcaaaaggggaataagtatctcacatggcaggtgcagggcaaagagaggggggaagggaagtgccacacaaccagatcttgtgagtactcagattttgtgaggggtgcttgaggtcatggatacccatttaccctgatgtgtttatacacatttcatacctgtattaaaatatctcatgtaccccataaacatatacacctactttgtacccacaaaaatttaaaaataaagttaatttcaatgtttaaagacttgttatt

SEQ ID NO: 202290 - DNA, 8738 bp, Homo sapiens
  Payload ID: 19903
  Gene Name: zinc finger protein 37A
  Uniprot ID: P17032
  ENST ID: ENST00000361085
  CDS Start-End: 346-2031
gtgcacttttcggcccccgtcgcgggagccgcttcgggccttctgggcatgtctgccatatggctccaggtttgtttttctccccggcactctgacggggagggctcccggcatctcctggcgtccgggtagaggacgcggaggatgctgagctgctggcgcactgcagcacaactagagatgtacggatgcccccatcttgatcttacagaatcagaggtacagccgcgagaaaggtctagtcaagaacagacagagtcgcttgaggactcaggagggtgtttgctgcgttgacaacagactacaccctcacagtttgctctgctcttccaacaccagtggaagatgatcacatcccagggatcagtgtcgtttagggatgtgactgtgggcttcactcaagaggagtggcagcatctggaccctgctcagaggaccctgtacagggatgtgatgctggagaactacagccaccttgtctcagtagggtattgcattcctaaaccagaagtgattctcaagttggagaaaggcgaggagccatggatattagaggaaaaatttccaagccagagtcatctggaattaattaataccagtagaaactattcaataatgaagttcaatgagtttaacaaaggtggaaaatgtttctgtgatgaaaagcatgaaataattcattctgaagaggaaccttctgaatataataaaaatgggaacagcttctggctgaatgaagacctcatttggcatcagaaaattaaaaattgggaacaatcttttgaatacaatgaatgtgggaaagctttccctgagaattcactcttccttgtacataagagaggttacacaggacagaaaacctgcaaatatactgaacatgggaaaacctgtgatatgtcatttttcatcactcatcagcaaacacatccaagagaaaaccactatggtaatgaatgtggagaaaatatctttgaggaatccattctccttgaacatcagagtgtttacccattcagccagaagttaaatctcactccaattcagagaacccactcaattaacaatattattgaatataatgagtgtggaacatttttcagtgaaaaattagtccttcatttacaacagagaacacatacaggagaaaaaccttatgaatgtcatgaatgtggaaaaaccttcacccagaagtcagcccacacaagacatcagagaacacacacagggggaaaaccctatgaatgtcatgaatgtgggaagaccttctataagaattcagacctcattaaacatcaaagaattcatacaggggagagaccttatggatgtcatgaatgtgggaaatccttcagtgaaaagtcaacccttactcaacatcaaagaacgcacacaggggagaaaccatatgaatgtcatgaatgtgggaaaaccttctcatttaagtcagtccttactgtgcatcagaaaacacacacaggggagaagccctatgaatgctatgcatgtgggaaagcctttctcagaaaatcagacctcattaaacatcaaagaatacacacaggtgaaaaaccttatgaatgtaatgaatgtgggaagtcattctctgagaagtcaacccttactaaacatctaagaactcacacaggtgagaaaccttatgaatgtattcagtgtggaaaatttttctgctactactccggtttcacagaacatctgagaagacacacaggggagaaaccttttggatgtaatgaatgtgggaaaaccttccgtcagaagtcagccctaattgttcaccagagaactcatataagacagaaaccctatggatgtaatcaatgtggaaaatcattctgtgtgaagtcaaaactcattgcacatcatagaacacacacaggggagaaaccctatgaatgtaatgtttgtggaaaatcattctatgttaagtcaaaactaactgtacatcagagaatacacttggggagaaaccctataaatgtagtaaacgagggaaattactctgggtgaagtcagaactttgtagaacacagaacataaagggtgagagaaatctgttaatataatgataatgagaacacctttgccctgaagtcagttctcacagtatagaagagaacttaaagagggaaaaaacaatatgaagatagggaatgcaggaaaacattattctggaatttggaccatacactatgttacaaaactaaaagtggaaaaaacttattggtgaatgaatataggaaacattttgcccaatgccactcttcattaaacatcagagaattcacacggggtgaaacctgggtcagcatccctaggttgagaagggatgcatttttctgctactactacagtttcacagaatacctgagaagacacacttggagaaaccttttgggtgtaatgaatgtgggaaaacctttcatcagaagtcagctctaattgttcaccacagaactcatataagacagaaaccctatgggtgtaatgaatgtggaaaatcattctgtgtgaagtcaagaggccagagaaaatgcacaaactgtaggaaactataggaaagcatttactatgaggttatattttatggagtatatgtaataagaagtagcttctcagtgaacatcagatagtagagaaagtatttttaactgtatccaatgtgtggatgttttaagttaaaatctaaatttaatatagaacagaggtgttgagttgcaggatatctagcaatttaagaaaatgtggaaaaaatatttttattgagaaatagcattttactttgttaatatctagtttagttcattgtcaagactgctattttctaagagacttctaaagacgccactcaagccaatggctataagtagttcaaaggtttattgcttagccatatgaaaaataagggaagattttttagcaaggggacccacaaacaagagtgctcttgtatgtccagaagaaagagaaagaccatcaatcaggggccatagtacaggagcccaccagcaggatttttgaataatcctagggcagactaaattcagacgacccatctcagaatggtggatcaaagcagcaagtcaatttgccttgtatgcaacttatgaggattagtagaagagagtgggtccagatttctggtggtttctgccctgcagatgtctaacacataagccaggacattctgctgtgagtgacttattgtacccaactctatttctctccatactgaaacatgtctttcataggtgatacaactttttaaaatgtatgtgtagatataacttaaatatggagctttcaaaaagcacaaataggctggacatggtggctcatgcctgtaatcccagtactttgggaggctgaggtgggcaaatcacctgaggtcaggagttccagaccagcctggccaacatgatgaaaccctgtctctactaaaaatacaaaaattagccgggcatggtggtgcacatcggtagtcctggctactagagaggttgaggtgggaggatcacttgaacctgggaggtgggggtttcagtgagctgagatcatgccactgcactccagcctgagtgacagagagagattcaaaaaacaaaaaaaaagcaaaaatatactttgctattgggtaaggtatagtagttggcagcagaatggacccattgaggataactataaaattacagaaaatatttaaatgcaacttattgctatagaagcaaagaggactaaagggcaaaattctagagagtggtaaatctcagaaagcacaagcataaaatgcagctctgggggccctttccacttctggctatagggaagaacctgaatactgaacttgattcaggcagaggaccataacctgggggtcaggggaaggcatgggggggaccagaaaccagaagaacaatcaagactgcaatgaaaaaaatggatacattaggagcttcaaacacatataatttctcaagaaatttccagatgtctcatgctgcatagggcaggagcctgaaaagctaatttgagaagataataagtaggatttttgttttgttttgcattttgcagtacaaaggagaaatgattagaacttaggaagtgccagtgggttggtgaacatgccatcagtaaaagccctggaaacaaggtcatactagagattggttgtgccttgtcacaactgcaaacaatacctgagtggagtattcaaaaacttgcttagaaagaaaactctaggaacagatggcttcactgaagttattccaaatatttaagaaataataccaggcttttataaacttttctagaagaaaaaagatggaacttttccaattcagtttttgaggccagtacaaccttgataacaaaacctaaaaaaaaaacaacaaaaaaacccataaagctatagaccaaagtctcatagatttagatgcaaaatcctaaaattgaaaaaaacatctagccatatccataaactatatcatcaccaagagatgtttattagggcaatcaaaagatttattattttaaaaaaatcagtgtggacttccattcctctttcttttgattcccccctttgacttttcatgtatctctcctgccttccttccccagagtggaggagttagacttgcctcgtgggatgagaggagttgtggctttgtgtctgctggcaccaagagggctgagggtgaggtgtggaagggacagggggaggagatgggcagcattgttgagagattggtaacactgagcaaataaatatgttgagaatgatgacagcaagatttctccattagagaaggtatttataaaaataggaatgaggagagctagaaaacctggagtgtggcattagaatagaactcatatcttttaaatatataggaacaaataaataaattgttgtgtgtgcacatatgcatatattttgtgttcattctactgagaggacctaaacacaatgacacctcagtaacagtaagcacaccaactgccaagttattagttcctaaatactatccacaaaaaaggggaacagggatgattcctagtcagagattgggagaaatacaagatgagcctgaatcatctcatgtacctgacagtaagaaaatactctggctggtctcagtggctcatgtctgtaattctagcatgttagaaggtcaaggtgggtgggttgcttgagctcaggagtttgagaccagcctgggcaacatggcacaattgtctctacaaaaaatacaaaaattagccaggcatggtggcatgcacctgtagtccgaggtactcaggaggcagagacgtgggaggatcgcttgagcctgggagattgaggctgcactgagctgtgatcgtgccactgtactctagcctggaagacagagtgagaccccatctcaggaaaaaagaaaaaaaaaaagatgtcattcagcaggttaatggataaactgtggaacatccagaaaactttaacattcttcaaagaaatagaaaacacaatcctaaaatttatatgggaaccacaaaagacttagaatagtcagctatcctgagcaaaaggaatcaaactggaggaatcatattacctgacttccaattattcaacagagctacagtaaccaaaacagcatgatactggcataacaacagacacataggaacagtatagacaacccagaaacaaattcatacatctatggtgaccacttttgacaaaggaatgaagaacatacactggggaaaagataatgtctttaataaatggtgctgggaaaactggatatccatatgcagaagaatgaaactagacccccatctcttagcatatacaaaaatcaaaattaattaaaaagttaaatctaagacctcaaactatgaaacagctaaaagaaaacatcggggaatctctccaggacattggagtgggcaaagatttcttgtgtaatacctgacaaacaggcaaccaaagcaaaagtggacaaatgggatcacatcaagttaaaaatcttctgcattgcaaaggaaataacaaagtgaagagacaacccatagaatgtgagataatatttgcaaactatccatctgtattaggccatttttgaagtactacaaagaaatacttgagactgagtaatttataaagaagaggtttaattggctcacggttttgcaggctgtacaggaagcatggtgctaacatctgatcagcttgtagggaggcatcaggaagtttccaaccatggtggaaggcaaaaggggaataagtatctcacatggcaggtgcagggcaaagagaggggggaagggaagtgccacacaaccagatcttgtgagtactcagattttgtgaggggtgcttgaggtcatggatacccatttaccctgatgtgtttatacacatttcatacctgtattaaaatatctcatgtaccccataaacatatacacctactttgtacccacaaaaatttaaaaataaagttaatttcaatgtttaaagacttgttattaaaataatagcagtttctataaatttaatatttcaataaaactcccagtatttattgttaacactggaaaaagttttccaaaacgtatatggcagaaatatgggccttgatgtgaggacagcatcaattaatgagggatcctctcccttgatcaaaacaccttccaccaagacccacctttaacgctgagcattacctctcaaagtgagatttgggcagggactaatatccaaactgtatcaacatctgacaaggtgttcacaaccagaatatataaggagctataacaattctatagaaaaaaaaatctgatttaaaactgggcaaaaatctgaatagacgtttctcaaaagaagacatacaaatggcaaacaggcatatgaaaaggtactcaacatcattgatccattagagaaatgcaaatcaaaactacaataagatatcatctcaccccagttaaaatgtcttctctccaaaagacagataataacaaatgctgaagaggatgtggagaaaagggaaacctcgtgcactgtggaaatgttattagtacaaccactatggacaacaatttggaggtacctcaaaaactaaaaatagagctatcatacaatcccacaattccactggtagttatataccccaaagacaggaaatcagtatattgaagatatatctgcaccgtgtttactgtagcactactcacaatagccaagatttggaagcaacctaagtgtctaacagcagatgaatggataaataaaatatggtacataaacacaatggagtactattcagccataaaaaagaatgagatcctgtcatttgcaacattgtagatggaactagagatcattaagtgaaataagccaggcacagcaagacagacatcatgttctgacgtatttgttggagctaaagatgaaaacaactgaacttatagagggtagaaggatgtttaccagaggcgggaaaggcagtgagggcatggtgagggggaagtggggaatgttaacgggcacaaaatgtagaatgactaagacctagtatttgatagcacaaggttactacagtcaataataattgtgcattttaaaggtataattgaattgtaacacaaaggataaatgcttgaggttatggataccccatttaccctgatgtgattattagacattgcatgcctatatcaaaatatatcatgtaccccatagatatatacacctagtatgtacccacaaaaattaaaaataaagtaaaatttcaatgattaggaagaccattgttaatatcagtttcctttaaatgtttctataaatttaatacaatttcaataaagctcccaatatttattcttagtactggaaaaagttttccaaaatgtgtatggcagaaatagggccaaaataggcaagaaaactattttcgagatgtcagttttcctcaaattgttctattaattaaacgccacctgaattaaaatttgacaagtggattataaatttatgtggacattcaaaacaattatggatacatgagtccagaatcacagccataaaccatgaggtgcttgggagattttcagaaaatatgccaatgaaatccaaggggaaagacatgtcttcaaaaagtggtgttacctttgactccccaaagcatatataaagcctctactcatcatagatctaaatataagagctcaaacttaaaacttgtagaagaaaacatgagaaaatttttgtaggtttgagttagatgatgatttctatataggacaataaaaatatggaacatacaaaaataaatttaatgcacttaattataatacaaatgatttactcactttaaactttgataaattagattttgttaaattcaaaagcttgtgttcttcaaagcacacagttaaggaaatggaaaggcgagtaatggactaaaaaaaatacctgtaaaacagctttggttaagaatagaagaaaaatcctaataagaaaattggtgaaagaatggtgtggaaagttcactacagaaaaaatatgaatggcaaataatcctgatttgggggagagtgttcaataccaatgctaattttttaaatgtcctgtgtttaattttttggagtttgtgatttgcaacatgcccctactgcatggagggagaggagatggtaaaatgaacagaagtaataattgtaaa

SEQ ID NO: 202291 - DNA, 8329 bp, Homo sapiens
  Payload ID: 19904
  Gene Name: zinc finger protein 382
  Uniprot ID: Q96SR6
  ENST ID: ENST00000292928
  CDS Start-End: 114-1766
gactcaccctgggccgggggtgaggcttggactgtttctttttccaaaagaggagctcaaaagagaaagttcatctagaaatctcaaagccatgtctcaggatgaactagagtatgcccttacagggatcagtgtcattcaaggatgtgactgtggacttcacccaggaggagtggcagcaactagaccctgctcagaaggcgctttacagggatgtgatgttggaaaactattgccacttcgtatctgtggggtttcacatggctaagcctgatatgatccgcaagttggaacaaggagaagagctatggacacagagaatttttccaagttacagctacctagaagaagatgggaaaactgaagatgtcttagtgaagttcaaagaataccaagacaggcattctagacccctcatattcatcaaccacaaaaaactaattaaggagagaagtaatatttatggtaaaacatttactctaggcaagaaccgtatttcaaaaacaatactatgtgaatataaacctgatggaaaagttttgaaaaatatttcagaactagtcattagaaatataagccccataaaagagaagtttggtgacagtactggatgggagaaatcactcctcaataccaagcatgagaaaattcatcctgcagtgaatctccataaacaaacagaaagagttctcagtggtaaacaggagcttattcagcatcagaaggttcaagctccagagcaaccatttgaccataatgaatgtgaaaaatccttcctgatgaaaggaatgctatttacacatactagagctcacagaggagaaagaacctttgaatacaataaagatggaattgccttcatagaaaagtcaagcctcagtgtccatccaagtaatcttatggaaaagaagccctctgcctacaacaaatatgggaaattcctctgcagaaagcctgtttttattatgcctcagagacctcaaacagaagagaaaccctttcactgtccttactgtgggaataactttagaaggaagtcatacctcattgaacatcagcgaattcacacaggtgaaaaaccttatgtttgcaatcaatgtggaaaggccttccgtcagaagacagccctcacccttcatgagaaaacacatatagaggggaaaccctttatttgtatcgattgtgggaagtccttccgccagaaggccaccctcactagacatcacaaaacacatacgggggagaaagcctatgaatgtcctcagtgtggaagtgcctttaggaagaagtcatacctcattgatcaccagagaactcacacaggagagaaaccgtatcagtgtaatgagtgtgggaaggcatttatccagaagacaaccctcactgttcatcagagaactcacacaggagagaaaccctatatttgcaatgaatgtgggaagtccttctgccaaaagacaaccctcactctccaccagagaattcacacgggggaaaaaccctatatttgtaatgaatgtgggaagtccttccgccagaaggcaatcctcactgttcatcacagaatacatacaggagaaaaatccaatgggtgtcctcagtgtgggaaagccttcagtaggaaatcaaacctcattcgccatcagaaaactcacacaggcgagaaaccatatgaatgtaaacagtgtgggaagttcttcagttgtaagtcaaacctcattgtccatcagaaaactcacaaggtagaaaccacgggaattcagtaagtaatgtggctttttttgtaaaaaaatgttaagtcatagtaaaccctgtagatgatgttgcttgcaagcgtaatatccaacagtttaaggtactataccacatggtaacctactgtttgccagcctgtaaaacacacacacacacacacacacacacacaaatattattagacaaattagatgacaaaaatcattaagaagtccaaactttttttttattactagcttcagcagacaaaaacttcctctgtcaaggtgttataaacatttaaaatcacattttccatttccatacatatctttttgttcatcagtaataactagttggccaactgactgtggtccatggactacacagtgagtagaggttctttaaaagaaggaggtatgaactgtatttctcattgcaaatacaaaataaaaattagttgttacctcctcacagttgaccatgattctgacttctaacattacaaattagtttttactattataaacctttctataaattggattatatatcatgtattctttcatatacagcttattaccttcatcatgtccgtgagtctaatcattagtacgtgtggcagaagtttatttatttttatccagtatagaattcaattatatgattatatcacaatttatccattctgctgttgatggacttttacattgtttacagcttagggtcataataaatcatgcttctgagaacatacttgtcttggtgtacatacatgtatttctcttgtgtatatacttaggagtggaatcgctgggtcttagagcatgtgtgtattcagtcagatactggcagacaattcagaactttcaccacatgagataattgacactgaagggaaacagctataaattttatcaatatggtgctggttcaaaccagagaattcatgctgcagggaaactcaatcaatgttattgtgaaaactgggaatgtgaatgtaatatatgtagaaaaacatttagccacagcccaaatcttccaggcaaatgtaataaacgtgacattgccgttagccacagtaaatgccttatttgaactcaaaaagtctactagaggagaggcatccagcatttcccttgttcaacatcagagaattccaactagagaaaagtcctgtgactgtgttgaagttagggcgtggggaggaatatagtctttacctatggtctgtatctactggtcaggtacaaatgatgaatatggaaaagcttatagccatcattcatatattatactacaccagggaattcacataggatgagaactcttcaaatgaaatgattgtaagaatgactttaactgttgctcatttcttttacaccatcaaagaattaataccaaagaaaggaagattacaaggaaacaaatgggtcttgggacttttttttttttttttttgagacagaatcttgctctgtcacccaggcgggagtgcagtggcatgatcttggctcactgcagcctctgcctcccaggttccagtgattctcctgcctcagcctcccgggtagctgagattacaggcacacgccacacgcacagctaattttcgtatttttagtagagacagggtttcatcatgttggccaggctggtctcgaactcctgacctcaggtgatctgcctgcctcggcctcccaaagtgctaggattacagggacttttaactctggggaaagctctctttcatgaaagaagtctagccataccgagaccataatgctaggaagtctatgtgtaggccccctggtcaacagctacagctgagctcccagccatcagctagcatcagctgccaaccatgtaagtgaggcctcttggacatccagtcaagccttcagatgactgtggaccctgctaacacccaactggtaccacaaatgagacctcaagcaagaactgcccagctgaggccttcccaaattcctggccaacaaaatcatcaggctttttaactacaaacagttttattttttatttaataaaaaagtttttatttaacttgattgttttattaaaagggaaaagtaattttttagtatctgttaatatataataaaaataaaggtataagcctgggcttggtggctcatttctgtaatcccagcactttgggaggtgttgggaggatcacttgagcccaggagttcgagaccagcctgggaaacatgccaaaaccccatctctacaaaaaattagccaggaatggtggcacatgcctgtagtcccagctactcgggaggctgagtgggaggatcacttgggcccgggaggcggaggttgcagtgagccaggatagcaccactgcactccagcctgggtaacagagcgagaccctgtctcataaataaataaatacataaaggtgtaaatatatggattctagagtcaatgagcaaaggtattgttgttactaataggtgattttggcatgaagaaaaactggccataaaatacagttgaagatttggctgcatttttgccttacgattacataccttaataattacaactcaattgaggggtccatatatattctttctcattttctggcagtaaatcatattcatcatatacttcccaattttgcacacacaaaaaatgaaaatagcccccaaaagaaaggcaggataatgcgatctatcctcaaaagaccccgtgctgtcatttctcaacaaaggcgcagagagaaatcaaggtatggaatctaatgaatgtccgtgaaggaggtacttttgaatgctttaaagaaagtctaaataaagttgcgttttcttttctttttttttttttttgagacagagtttcacttttgtttcccaggctggagtgcaatggcgcaatttcggctcattgcaacctctacctcaagcaattctcctgcctcagcctcccaagtagctgggattacaggcgcccacctgtatttttagtagagacggggtttcatcatgttggccaggctggtctccaaagcctgacctcaggcgatccacccgcctcagcctcccaaagtgctgagattacaggtgtgagccaccgcacccagccgaaattgtgttttctaaagctatttacatataagctgccgctccttaggaaaatttggtcctgtggtttatattttggcatgaaacagcattgggctgtattccagaatcctgcttgaagatttcttttgaagaaatcagaaattttctttgcattttttttatttttttgagacaggttctcagtctgtcacctaggctggagtagagtggtgccattatagctcactgcagacttgaattcctggactcaagcaattctcctgcctcagcctcccaagtagctaggactacaggcaggcgccattcctctcagctaatgtttttattttttatacatatggggtctcgttgtgttgcccaggctggtattgaactcctggcctcaagcaatcttccctcttcggcctcctaaaatgctggggttacaggtgtgagccacttcactcactttagagattttcactttatgaattgataaatacagcattgcatcacttaatagggatacattctgagaaatgcatcatgaggcagtgtcatgatcgtgcaagcatcacagagtgctgatacaaaccgagatggtacagcctactaaacacctaggctatatggtagagcctgttgctcctaggctacaaatctgtactgcatgttactgtgctggatactataggcaattgtaacacaatggtaattatttgtatatgtaaacctatctaaacacagaaaaggtacagtaaaaatgtggtactataatctttttttttttttgagacagagtctcactctgtcgcccaggctggtgtgcagtggtgtgatctcggctcattgcaacctccgcctcctgggttcaagtgattctcctgcctcagcctcatgagtagctgggactacaggtgcacaccaccaaacccggctaatttttgtatttttagtagagacggggtttcaccatgttggccaggatggtctcaatctcctgacctcgtgatccacccgcctcggcctctcaaagtgctgggattacaggtgtgagccaccatgcctggctggtactataatcttatgagaccaccattatatatgcagtccatcatggaccaaaatgtcatgtggtgcatgagtatttttcatctaacttatatattgctcaatgaagtttgggcaactctaaggagcaaacatgtttatagaatctaagtcaacttgacctaaacatatacgacaaaataggagtgattttacaaattcatattttgtagacctaactgcaaggtcataaggcatatgcaaaatgagttcatcagttcagaggactaacaggactccacagagcatacccaggaaatgtttttacttagaagcaaaggatgtggctcagcaaaagaaagggaaggtaagcattagggctcagaatcatctagctgcacattcctcagtggttttattcacacacagaccgcacactgtctctgaactgaagcactaagacctgtatcaaacttgatttggggagagctgacagcagaacttctctacatgggtttttttgttgtcattgttttgttttttgagacagagtcttgctctgtcacccaggctggagtgcaatggtgcaatctcagcccactgcaacctccgcctcccaggttcaagcaagtctcctgccacagcctccctaagtatctgggattacaggcatgtgccaccacaaccagctagtttttgtgtttttagtagagacagggtttctccatgttggccaggctggtctcgaagtcctgacctcaggcaatcctccgcccacctcggtttcccaaagtgctgggattataggcatgagccaccgtgcccagccactgcatgggtatttatgcttctctgttcactggttacatagtcaagccaggctatctaactggttatgtaagtttaaaaaagttaaaaagccatcataaacaaattggctctgggagtctcccagggaatatcagactttaactagtaccttgtatagctcactggccttatcccaaccaagagtcagagccagacatctgggcatcgtggagataattttagagctttgcagtctgactgtaaatcagctccatcttataaacatggttcctataactgctgtgtatttcctgataatgtatgtgaacaagcatatctcctcaccctctgtgtccccagtatcagatagtgcacagtacatctcaaatgtgatcatttcttgtcagctaatgcttgaatttctccactcagtttctggtctagcaatagagccaggcttgccatgtcctgcttcacaagtaatgtgcaacagcaaaagcacaggctccaacactagtctacaacatgcacctgggatgttctagatatttatcagtttataatcaggctttttttttttttttgagacagtgtctcgctctgtcgcccaggctggaggcagtggctcgatcttggctcactgtaagctccgcctcctgggttcacaccattgtcctgcctcagcctcctgagtagctgggactacaggcacctgccaccatgcccagctaattttttgtatttttagtagagacggggttttactgtgttagccagggtggtgtcgatctcctgacctcatgatccgcccacctcgacctcccaaagtgctgggattacaggcgtgagccaccgcacccggcctataatcggacttttcaaaaccctagatatgtgacaataccaagtgctgacaagaatgtggaacaactggaactctttcttttttaacttttgttttagattcaggagtacaggtgtggatttgttactggaactttcatacattgctaataggaaaggcaaaatggtaaagccggtctggaaaacaatatgccagtctcaaaaagttacacatccaatatgacccagcaatcccacttataagtacttatcctagagaaatgaaaaattatgtgcacacagaaacctgtacatgagtgtttgtaagtattatttataattaaaaaaaaaactagagacaagcaaatgttcttcagtgtgtaaatggatacactgtggtacattcccaagatggaattctactcaacgataacaataatgagctactgaaacatgcagctacatagatgaacctcaaatgcattacgctaaaggaaagaacccagtcccaaaaagttacatactgtatgattccatttatatgacatgctggaaaaggtgaaaatataacaacagaaaacagatcaaatgttgctgagtgtctggggtggggtggggtctgaatacagaggggttgcacgaggcaattctttgaggtgttggaattgttttgtatcctgcttgtggtcatagataaaaaatctatgcatgtgtaaaaaatagaagtatacatacaaaaaagtgaattgtactgtctgtaatttttttaaataaataaaaatccctagctctgcttc

SEQ ID NO: 202292 - DNA, 2657 bp, Homo sapiens
  Payload ID: 19904
  Gene Name: zinc finger protein 382
  ENST ID: ENST00000423582
  CDS Start-End: 710-2215
agtcccgcgggcccaatcggggacagtcagggctgtcccgggctgtgcacctgctgtgcacacacaccccctgctgtgcacaccccccgcccccccgggaccatcacaggcgcgcccactcacaccaccacacacggacgcagccacagaacggcacacacaaacacaatcacacagtctccctccccagcaggtgacttgcacacaggcctggggcttctgcctccacaaaccctctccgcgtcccatgaacccaggtcccctgccgtgagctcttctcgcatccagacccgggtcacctcaactcaccacatggaaaacgaacaccaggtcaacggaaaagggagccggggtcctggcagaagcgtagtgccagccgcaatagggcggccgtgggtgcaaacggaggggagcgccggcagctagcaccgcgcggcgactaacgggccgccccggagactcctgggagctcaggcccacgcgcgagtgcgcaggcgcagacgactcaccctgggccgggggtgaggcttggtgggtgccaggggtgctgaggaggccaaggagggcactgggagctccgttccgggagagctgtctaaggacgcggaaccgggtggggaggccagggaggactgtttctttttccaaaagaggagctcaaaagagaaagttcatctagaaatctcaaagccatgtctcagggtttcacatggctaagcctgatatgatccgcaagttggaacaaggagaagagctatggacacagagaatttttccaagttacagctacctagaagaagatgggaaaactgaagatgtcttagtgaagttcaaagaataccaagacaggcattctagacccctcatattcatcaaccacaaaaaactaattaaggagagaagtaatatttatggtaaaacatttactctaggcaagaaccgtatttcaaaaacaatactatgtgaatataaacctgatggaaaagttttgaaaaatatttcagaactagtcattagaaatataagccccataaaagagaagtttggtgacagtactggatgggagaaatcactcctcaataccaagcatgagaaaattcatcctgcagtgaatctccataaacaaacagaaagagttctcagtggtaaacaggagcttattcagcatcagaaggttcaagctccagagcaaccatttgaccataatgaatgtgaaaaatccttcctgatgaaaggaatgctatttacacatactagagctcacagaggagaaagaacctttgaatacaataaagatggaattgccttcatagaaaagtcaagcctcagtgtccatccaagtaatcttatggaaaagaagccctctgcctacaacaaatatgggaaattcctctgcagaaagcctgtttttattatgcctcagagacctcaaacagaagagaaaccctttcactgtccttactgtgggaataactttagaaggaagtcatacctcattgaacatcagcgaattcacacaggtgaaaaaccttatgtttgcaatcaatgtggaaaggccttccgtcagaagacagccctcacccttcatgagaaaacacatatagaggggaaaccctttatttgtatcgattgtgggaagtccttccgccagaaggccaccctcactagacatcacaaaacacatacgggggagaaagcctatgaatgtcctcagtgtggaagtgcctttaggaagaagtcatacctcattgatcaccagagaactcacacaggagagaaaccgtatcagtgtaatgagtgtgggaaggcatttatccagaagacaaccctcactgttcatcagagaactcacacaggagagaaaccctatatttgcaatgaatgtgggaagtccttctgccaaaagacaaccctcactctccaccagagaattcacacgggggaaaaaccctatatttgtaatgaatgtgggaagtccttccgccagaaggcaatcctcactgttcatcacagaatacatacaggagaaaaatccaatgggtgtcctcagtgtgggaaagccttcagtaggaaatcaaacctcattcgccatcagaaaactcacacaggcgagaaaccatatgaatgtaaacagtgtgggaagttcttcagttgtaagtcaaacctcattgtccatcagaaaactcacaaggtagaaaccacgggaattcagtaagtaatgtggctttttttgtaaaaaaatgttaagtcatagtaaaccctgtagatgatgttgcttgcaagcgtaatatccaacagtttaaggtactataccacatggtaacctactgtttgccagcctgtaaaacacacacacacacacacacacacacacaaatattattagacaaattagatgacaaaaatcattaagaagtccaaactttttttttattactagcttcagcagacaaaaacttcctctgtcaaggtgttataaacatttaaaatcacattttccatttccatacatatctttttgttcatcagtaataactagttggccaactgactgtggtccatggactacacagtgagtagaggttctttaaaagaaggaggtatgaactgtatttctcattgcaaatacaaaataaaaattagttgttacctcctca

SEQ ID NO: 202293 - DNA, 2742 bp, Homo sapiens
  Payload ID: 19904
  Gene Name: zinc finger protein 382
  Uniprot ID: Q96SR6
  ENST ID: ENST00000439428
  CDS Start-End: 76-1725
ggggtgaggcttggactgtttctttttccaaaagaggagctcaaaagagaaagttcatctagaaatctcaaagccatgtctcagggatcagtgtcattcaaggatgtgactgtggacttcacccaggaggagtggcagcaactagaccctgctcagaaggcgctttacagggatgtgatgttggaaaactattgccacttcgtatctgtggggtttcacatggctaagcctgatatgatccgcaagttggaacaaggagaagagctatggacacagagaatttttccaagttacagctacctagaagaagatgggaaaactgaagatgtcttagtgaagttcaaagaataccaagacaggcattctagacccctcatattcatcaaccacaaaaaactaattaaggagagaagtaatatttatggtaaaacatttactctaggcaagaaccgtatttcaaaaacaatactatgtgaatataaacctgatggaaaagttttgaaaaatatttcagaactagtcattagaaatataagccccataaaagagaagtttggtgacagtactggatgggagaaatcactcctcaataccaagcatgagaaaattcatcctgcagtgaatctccataaacaaacagaaagagttctcagtggtaaacaggagcttattcagcatcagaaggttcaagctccagagcaaccatttgaccataatgaatgtgaaaaatccttcctgatgaaaggaatgctatttacacatactagagctcacagaggagaaagaacctttgaatacaataaagatggaattgccttcatagaaaagtcaagcctcagtgtccatccaagtaatcttatggaaaagaagccctctgcctacaacaaatatgggaaattcctctgcagaaagcctgtttttattatgcctcagagacctcaaacagaagagaaaccctttcactgtccttactgtgggaataactttagaaggaagtcatacctcattgaacatcagcgaattcacacaggtgaaaaaccttatgtttgcaatcaatgtggaaaggccttccgtcagaagacagccctcacccttcatgagaaaacacatatagaggggaaaccctttatttgtatcgattgtgggaagtccttccgccagaaggccaccctcactagacatcacaaaacacatacgggggagaaagcctatgaatgtcctcagtgtggaagtgcctttaggaagaagtcatacctcattgatcaccagagaactcacacaggagagaaaccgtatcagtgtaatgagtgtgggaaggcatttatccagaagacaaccctcactgttcatcagagaactcacacaggagagaaaccctatatttgcaatgaatgtgggaagtccttctgccaaaagacaaccctcactctccaccagagaattcacacgggggaaaaaccctatatttgtaatgaatgtgggaagtccttccgccagaaggcaatcctcactgttcatcacagaatacatacaggagaaaaatccaatgggtgtcctcagtgtgggaaagccttcagtaggaaatcaaacctcattcgccatcagaaaactcacacaggcgagaaaccatatgaatgtaaacagtgtgggaagttcttcagttgtaagtcaaacctcattgtccatcagaaaactcacaaggtagaaaccacgggaattcagtaagtaatgtggctttttttgtaaaaaaatgttaagtcatagtaaaccctgtagatgatgttgcttgcaagcgtaatatccaacagtttaaggtactataccacatggtaacctactgtttgccagcctgtaaaacacacacacacacacacacacacacacaaatattattagacaaattagatgacaaaaatcattaagaagtccaaactttttttttattactagcttcagcagacaaaaacttcctctgtcaaggtgttataaacatttaaaatcacattttccatttccatacatatctttttgttcatcagtaataactagttggccaactgactgtggtccatggactacacagtgagtagaggttctttaaaagaaggaggtatgaactgtatttctcattgcaaatacaaaataaaaattagttgttacctcctcacagttgaccatgattctgacttctaacattacaaattagtttttactattataaacctttctataaattggattatatatcatgtattctttcatatacagcttattaccttcatcatgtccgtgagtctaatcattagtacgtgtggcagaagtttatttatttttatccagtatagaattcaattatatgattatatcacaatttatccattctgctgttgatggacttttacattgtttacagcttagggtcataataaatcatgcttctgagaacatacttgtcttggtgtacatacatgtatttctcttgtgtatatacttaggagtggaatcgctgggtcttagagcatgtgtgtattcagtcagatactggcagacaattcagaactttcaccacatgagataattgacactgaagggaaacagctataaattttatcaatatggtgctggttcaaaccagagaattcatgctgcagggaaactcaatcaatgttattgtgaaaactgggaatgtgaatgtaatatatgtagaaaaacatttagccacagcccaaatcttccaggcaa

SEQ ID NO: 202294 - DNA, 3865 bp, Homo sapiens
  Payload ID: 19904
  Gene Name: zinc finger protein 382
  Uniprot ID: Q96SR6
  ENST ID: ENST00000435416
  CDS Start-End: 1496-3145
aggaaatccatatgccaggccacttttgaaatattctattgttgatcaaacagtactttgtcctcttttcatatctttcagaaaattcctctttagctcatccaccaacctttaaaatactggttttcctcagatgctaattggttctcttcttcttcacagtccgtttttctctacgcacaatcagattcactctgaaggctacacttagtgtgattctagtgactctcaaatacccctctccactctagacctctgtccagagtgtcagaaccgaatattcaacctccagtagctatcaccacctgtatgttccacagacaaagtacatttccaaagcttacctcattacttcctttggtccagcttacattttcttccgtttcccattttcactttctagtcccagcagccatgcatttgcctatgcagataaaatgcctgtatcttttccactctacagccaatttacgaccatctctgttgtaatggtggtcatgtaggagcagttgtcctctgtcagcccgctgacacttccttaatctaggagacatttctaaccatggttacttaattgtcatttccacctaacatgtgataagccttttccagtcttcaggagtattacctcaaaacttttatcacataacgtgtgtcaacttatgtttattgatgttctttacattccttaaagcaacagacccaaagtagggcatgcctcacagtagaatgtataagacggtctattggaaggaaataaaatactaacaatttacattcgagagcagtattcattaacaatgtagattttcataaatgcctattgatggtttataaatagctacaatgttgggaatgtgttcagtatatctttaagaccactgttctgtaggaaaaaaaaatctagtatcatgtcataatatccccattgcctatctccatataccttttccttcttagagctcaaagactgtttcctaacatactgtgccttttgctatttcctgatttactaactggtttttttctccccatgaatttttaaaagctgatgccctgtattcctacaaaacaaattcgttgtgagtacaaaacttttatgtcctcaatgaagcctcggagtacaaaatgaaatttttccttgttttgtgacactttaccttgtacgtatttctgtcattgcatctgtaaaacctactaagtgcatgtatttacatgtatgcccctctcttagcctataacttctcatgagcagggtcagggttttattcattttggtctaccaggcaaccagtcacattcaggacaaatagtgtgatctcagtatgtttagcatgagattataagtaaatacaaatggatgtattttcagagagaattttatgcaatataaaacataaataaggaaactagtctgaccagtaaacattgtcagtactaggtctccaatatctagttctcacacatttccgatcacttcaggatgaactagagtatgcccttacagggatcagtgtcattcaaggatgtgactgtggacttcacccaggaggagtggcagcaactagaccctgctcagaaggcgctttacagggatgtgatgttggaaaactattgccacttcgtatctgtggggtttcacatggctaagcctgatatgatccgcaagttggaacaaggagaagagctatggacacagagaatttttccaagttacagctacctagaagatgggaaaactgaagatgtcttagtgaagttcaaagaataccaagacaggcattctagacccctcatattcatcaaccacaaaaaactaattaaggagagaagtaatatttatggtaaaacatttactctaggcaagaaccgtatttcaaaaacaatactatgtgaatataaacctgatggaaaagttttgaaaaatatttcagaactagtcattagaaatataagccccataaaagagaagtttggtgacagtactggatgggagaaatcactcctcaataccaagcatgagaaaattcatcctgcagtgaatctccataaacaaacagaaagagttctcagtggtaaacaggagcttattcagcatcagaaggttcaagctccagagcaaccatttgaccataatgaatgtgaaaaatccttcctgatgaaaggaatgctatttacacatactagagctcacagaggagaaagaacctttgaatacaataaagatggaattgccttcatagaaaagtcaagcctcagtgtccatccaagtaatcttatggaaaagaagccctctgcctacaacaaatatgggaaattcctctgcagaaagcctgtttttattatgcctcagagacctcaaacagaagagaaaccctttcactgtccttactgtgggaataactttagaaggaagtcatacctcattgaacatcagcgaattcacacaggtgaaaaaccttatgtttgcaatcaatgtggaaaggccttccgtcagaagacagccctcacccttcatgagaaaacacatatagaggggaaaccctttatttgtatcgattgtgggaagtccttccgccagaaggccaccctcactagacatcacaaaacacatacgggggagaaagcctatgaatgtcctcagtgtggaagtgcctttaggaagaagtcatacctcattgatcaccagagaactcacacaggagagaaaccgtatcagtgtaatgagtgtgggaaggcatttatccagaagacaaccctcactgttcatcagagaactcacacaggagagaaaccctatatttgcaatgaatgtgggaagtccttctgccaaaagacaaccctcactctccaccagagaattcacacgggggaaaaaccctatatttgtaatgaatgtgggaagtccttccgccagaaggcaatcctcactgttcatcacagaatacatacaggagaaaaatccaatgggtgtcctcagtgtgggaaagccttcagtaggaaatcaaacctcattcgccatcagaaaactcacacaggcgagaaaccatatgaatgtaaacagtgtgggaagttcttcagttgtaagtcaaacctcattgtccatcagaaaactcacaaggtagaaaccacgggaattcagtaagtaatgtggctttttttgtaaaaaaatgttaagtcatagtaaaccctgtagatgatgttgcttgcaagcgtaatatccaacagtttaaggtactataccacatggtaacctactgtttgccagcctgtaaaacacacacacacacacacacacacacacaaatattattagacaaattagatgacaaaaatcattaagaagtccaaactttttttttattactagcttcagcagacaaaaacttcctctgtcaaggtgttataaacatttaaaatcacattttccatttccatacatatctttttgttcatcagtaataactagttggccaactgactgtggtccatggactacacagtgagtagaggttctttaaaagaaggaggtatgaactgtatttctcattgcaaatacaaaataaaaattagttgttacctcctcacagttgaccatgattctgacttctaacattacaaattagtttttactattataaacctttctataaattggattatatatcatgtattctttcatatacagcttattaccttcatcatgtccgtgagtctaatcattagtacgtgtggcagaagtttatttatttttatccagtatagaattcaattatatgattatatcacaatttatccattctgctgttgatggacttttacattgtttacagcttagggtcataataaatcatgcttctgagaa

SEQ ID NO: 202295 - DNA, 712 bp, Homo sapiens
  Payload ID: 19904
  Gene Name: zinc finger protein 382
  ENST ID: ENST00000590785
  CDS Start-End: 161-712
gattatatcatcacttgtgtagtgtaaggtattaactttggtaagacattaatgtatacctcatttactaccttgaagttgtatctttatcttacttcaatagttttaaagtcgaaacagcttagaccaaaagtctcattttccatcatcagggtttcacatggctaagcctgatatgatccgcaagttggaacaaggagaagagctatggacacagagaatttttccaagttacagctacctagaagaagatgggaaaactgaagatgtcttagtgaagttcaaagaataccaagacaggcattctagacccctcatattcatcaaccacaaaaaactaattaaggagagaagtaatatttatggtaaaacatttactctaggcaagaaccgtatttcaaaaacaatactatgtgaatataaacctgatggaaaagttttgaaaaatatttcagaactagtcattagaaatataagccccataaaagagaagtttggtgacagtactggatgggagaaatcactcctcaataccaagcatgagaaaattcatcctgcagtgaatctccataaacaaacagaaagagttctcagtggtaaacaggagcttattcagcatcagaaggttcaagctccagagcaaccatttgaccataatgaatgtgaaaaatccttcctgatgaaaggaatgctatttacacatactagagct

SEQ ID NO: 202296 - DNA, 556 bp, Homo sapiens
  Payload ID: 19904
  Gene Name: zinc finger protein 382
  ENST ID: ENST00000460670
  CDS Start-End: 481-556
gcagacgactcaccctgggccgggggtgaggcttggtgggtgccaggggtgctgaggaggccaaggagggcactgggagctccgttccgggagagctgtctaaggacgcggaaccgggtggggaggccagggaggtaaccaagagtccgagccgggcctggaaattctgaggaggaaaccgggaccgcggtatccagacgctccgatctgtacgagccgggcctcgggcgtggtccatgggcgtgaccttgagggtgacccggagcgagctccgcgaagggggattttgcccgttctgatcccgcggaagcgccatcgctggcggcgggtccccgcgcggagcgggcgctgtgtgttcgcgcgcgcgggcgcgcgctgaataggggtggcctcctgcgcccaacctgctgcattttaggactgtttctttttccaaaagaggagctcaaaagagaaagttcatctagaaatctcaaagccatgtctcagggatcagtgtcattcaaggatgtgactgtggacttcacccaggaggagtggcagcaactagaccctg

SEQ ID NO: 202297 - DNA, 6760 bp, Homo sapiens
  Payload ID: 19905
  Gene Name: zinc finger protein 383
  Uniprot ID: Q8NA42
  ENST ID: ENST00000352998
  CDS Start-End: 259-1686
attgctctaaaaggcctctgtgccctgactgatcctccctccctgtcaactcctaatctttttattgtctccatagttttgccttttccagaatgttgtaatcatacagtatgtagtctttttgaattggcttctttcacttagcaatgtgcatttaagtttcctaagctgttgatcatgagactgagtccctttttatacttcaacagacatgagaacggcctcaaggaagactaaccatctgcaatactagaagccatggctgagggatcagtgatgttcagtgatgtgtccatagacttctctcaggaggagtgggactgcctggaccctgttcagagggacttatacagagatgtgatgttggagaactacggcaatctggtttcaatgggactttacactcctaagcctcaagtgatctccttattggaacaagggaaagagccctggatggttggcagagagcttacaagaggcctgtgttcagatctggaatcgatgtgtgaaaccaagttattatctctaaagaaggaagtttatgaaatagaattatgccagagggagataatgggacttacaaagcatggccttgagtactccagttttggagatgttttggaatatagaagccaccttgcaaaacaactgggatatccaaatgggcattttagtcaagaaatattcactcctgaatacatgcccacatttattcaacagacattccttactctccatcaaataattaataatgaagacagaccctatgaatgtaagaaatgtggaaaggcctttagtcagaactcacaatttattcaacatcagagaattcatattggtgaaaaatcttatgaatgtaaagagtgtgggaaattctttagttgtggttcacatgttactcggcatctgaaaattcatactggcgaaaaaccctttgaatgtaaggaatgtggaaaggccttcagttgtagctcatacctttctcaacatcagagaatccataccggtaagaaaccctatgaatgtaaggaatgtgggaaggcctttagttattgctcaaatcttattgaccatcagcgaattcacactggtgaaaaaccttatgaatgtaaagtatgtgggaaagcctttactaagagctcacaactttttcagcatgcacgaattcatacaggtgagaaaccctatgaatgtaaggaatgtggcaaagcctttacccagagctcaaagcttgttcaacatcagagaattcatactggtgagaaaccctatgagtgcaaggaatgtggcaaagcctttagtagtggctcagcacttactaatcatcagagaattcacactggtgagaaaccctatgattgtaaggaatgtggaaaggcttttactcagagctcacagcttcgtcaacatcagagaattcacgctggtgagaaaccctttgaatgtcttgaatgtgggaaggcctttactcagaactcacaacttttccagcatcagagaattcatacagatgaaaaaccatatgaatgtaatgaatgtggaaaggcctttaataaatgctcaaaccttactcgacatctgagaattcacactggtgaaaagccctataactgtaaggaatgtgggaaggcttttagtagtggctcggatctcattcgtcatcagggaattcatactaataaataataaaaattaaagcccctgtcaccttcctcatattttaaaccaaaaatcatgtctaatagttaccctcttccgtagttttttttaaaactttgtatttaaattttgtatccaaatgtatttcattccaggttataaattcggagtctaaagtgacattccctctctcccccagtcatataccgatgccagctgttctataattctttcattcattgttttgttctactttcttggtgacacattatactcatgtttatatttgcttgtgtttttagagctatcttttctgatctgtgtatttgtgtttgcaccagtatcacactgtttgaattgtgtgacctttaatatttttaaattccttgtggaggtttaactttgtttttgaagttagtgttagtctttttgttttattttattattattattatatgttttttgagacggagtttcactctgttgcccaggctggagtgcagtggcgcaatctcggctcgctgcaacctccacctcccggcttcaagcaattctcctgcctcagactcctgagtagctgggatcacaggcgtgtgccaccacaccctgctaattttctatttttagtagagacagggtttctccatgttggtcaggatagtcttgaactcctgacctcaggtgatccacctgcctcagcctcccaaagtgctgggattacaggcatgagcgattgcacctggctttattttttgttgagacggagtttcgctcttgttgcctaggctggagtgcaatggtgcaatctcggctcgtcacaaccttcgcctcccaggttcaagtggttcttctgcctcagccttttgagtagttgggattacaggcatgtgccacaacacccggctaattttttgtatttttagtagagacggggtttcaccatgttagccaggatggtctcaatctcccgacttcaggtgatccacccgcctcggcctccgaaagtgctgggattacaggcgtgagccactgcggccggtctttttattttacaaatgtacatttttaattgttaagccaaaatcacaaagcaaaaaattacaaactaaaaagccaaaattaattgtaatcatacttatagatggctgctctcaatttggtagagaaaatcgtgctatactttgcttttttaagaaagtgtaattatgatatgcatgctgtacccttaactgcttttatcatgccaaagatttcatgagtgccatttcagtaaatatagatttttattattttcatgacatatttaatgactttaaaatgactattcccattatggttgccactaaatttttgcagctataaaagctgacctcggctgggcacagtggctcatgcctgtaatcccagcactttgggaggccgaggtgggcggatcacaaggtctgaagattaaggccatcctggctaacagtgaaaccccgtctctacttagctgggcgtggtggcatgtacctgtaatcccagctactcgggaggctgagacaggagaattgcttgaacctgggaggcggaggttgcagtgagctgagatggtgccactgcactccagcctgggggacagagtgagattccgtctcaaaaaaacacaaaaactgctgacctcattggatgcttatttttacttttaaaacatttattttaattgctaaaattatctacattttctccttgtgagctgttttgttcccttacatcaatcctaatcccaatgccatactagaaagtaacactgttatgaaagtgttatttatcaatccagatattaattttttgtttgtttgtttttttttttttttgagatggagttcactctgttgcccaggctgaagtgcagtggcacaatctcagttcaccacaactgctgcctcccgggttcaagcgattctcctgcctcagccttcctagtatctgagactacaggcgcacgacaccatgcctggctaatttttgtatttttagtagagacagggtttcactatgttggccaggctggtcttgaactcttgaccttgtgatccacccacctcggcctcccaaagttcggggattacaggtgtgagccactgtgcccggtcaattattttttcttatagctattagtggtgtttttgttttttgagacacagtctcgctctgttgcccaggctggagggcagtggtgcaatctcggctcactgcaacctctgcctcccgagttcaagtgagtcttccgcctcagcctcccgagtagctgggactacaggcgcgcgccaccatgcctagctaatttttgtattattagtagagatggggtttcaccatattggccaggctgctctcaaactcctgacctcgtgatcctcctgccttggcttcccaaagtgctgggattataggtgtgagccaccgcccctggctgttagtggtattttaaaaaattatgtctaggcatctataataaggctgtatgtattggattgctgtgaagagtcaatgaattaataaatgcaaagtacctcaaactgttatcacataatacaggtttagtaaaagttttccactattatcagtgatatactcattatcataagtatcttcattaggatttatggaaaggattttaaccatgttgtttacctttggcaaatttgtaattcatggtggaaaaagagaaacacttgtaatgagtataacgaagcctttccctatcattattattcagtgtggaattttaaaaggaagagaaaaagtatgtgtgcatagtctttgttcagactttatcttttatgctacataaagaataccagtctgaggctgggcgcggtggctcacacctgtaatcctagcactttgggaggccaaggtgggtggatcacttgaggtcaggagctcgagaccagcctggccaacatggtgaaaccccgtctctactaaaaatacaaaaaaaacaaaaacaaaaacaaatagccaggcatggtgttgcatgcctgtaatcctagctactcaagaggctgaggtgggaggattgcttgaacctgggagttggaggttatagtgagctgagattgcaccactgcacactccagactgggtgacagagcgagactctgtcttacaaaataaaaaataaacggttaccaatctgaaaccctgaaaatatgatgagtagtagaaagcacagctgtcaaaaaagcaggaagagattataaaattttttctaatatttccccccaaaatgcagaaaacatactggcaacattatttgaccagaagaagcagtacaataggataaccatcaaatatctgattattaattcaatattccctcttaattaacatgggttaaggaataaatccctaatatatacattatttaaatgtacatgaaaatgaaaacaattgaaaaacctgtgagtggcagtaaaagttgtattggaagttttataacctaatatttgtgcatatattgtaatactaggaagaaaaaatatagaacccaaggaactaaaacaagctgaaatgaattgtgggaggaaggaggtagtattattttaaaaggcagaaataattgaaagaaaaaaactggatctgaatccaaaattgatatttgatggaagagaaaaaaaatgagacaaagtttagtgattccagaggtgaaataaggatgacaaataaacaatattgtatatgagaaattgaaatggctatatatgtaaacttaaaagaactgtgtcatttggggtaatgaaaatgtggcatgggtaaaggttgtacaattttgtttatatactacaggtcactcaactatacactttaaaagggtgaatattatgctgtgtgaatttgatctcaatttaaaaacttaaggctggttgcagtggctcatgcctgtaattccagcactttgggaggctgaggtaggagaatggcttgaggccaggagttcaagaccagtctaggtaacataatgagatccccctcccctcatctctacagaaaaaaaaaaaaattaaaacaacaaacttaaaagttggtattatagacatttttataatatatctgaaaatctggaaaaagtctgtgatttttaataagttgacgacatcagaattaactggaggtgtaaaatcttaatagacctccctccagaataaacttatttaaaaaaataagactggccaggcatggtggctcacgcctgtaatctcagcattctgtgaggccaaggcgggtggatcacctgaggtcggggatttgagaccagcctgaccaacatggagaaaccctgtctctactaaaaatacaaaaaattagccgggcgtggtggctcatgcctgtaatcccggctactcaggaggctgaggcaggagaaaggcttgaacccgggaggcagagattgcggtgagcggggatcatgccattgcactccagcctgggcaacaagagtgaaactctctcaaaaataaataagtgaaataaaatttttcttaaaatatattttaaatgtcaaattgctacactaaaaaagacaccaaggtagagatttttataggtgaaatctatgaaatgtcttaggaaactcttctaggacatagactgagatagcaaattatctatttttaaaatttgtcataatcctgatgttacaacctactagaacccaaaacaatttgtccagaatcagttatgaaaatacagcattataaattagcaaatcaaatctagtaacccattgaaaataaatatttgtcacattctgaatttaggaaaaaacaattctgataaatcaaactttctactttctgaaacttgaaaatcaaattgatttagataagattgtatttcttagtgtctgaactcaggaaccaaatagatgtggatagcatgggatttttggaatacaagataagataatttacatgggattgcaaaagttcaaataactaaagttctgtcaatgaaaatatatgctctaacctcaacatcttctagatgaacccttttttctagcagtatttgacaggatgggatatattttataaataaacttggactattatcc

SEQ ID NO: 202298 - DNA, 2268 bp, Homo sapiens
  Payload ID: 19905
  Gene Name: zinc finger protein 383
  Uniprot ID: Q8NA42
  ENST ID: ENST00000589413
  CDS Start-End: 584-2011
tgcatgggagtttgaagggactgaccaggctggtctggagtgttgggcatgcggagtttcgctgttgttgcccaggctggagtgcaatggcgcaatctcggctcaccgcaacctccgcctccccggttcaagcaattctcctgcctcagccttcctagtagctgggattacaggcgtgtgtcaccacgccctgctaattttgtattttcagtagagacggggtttctccgtgttggtcaggctggtctcgacctccccacctcagatagtagctgtagatccaaaatgacctctgatctgctcagtctgggccacaagaaaggcctggcatctcatcattcctttcttcttcagctctgctctcgtcaagagagttacccagaggaagaatggctgttgaccaaaccaaatacaagacggagtctcactctgttgcccaagctggagtgcagtggcatgatctcagctcactgcagcctctgctttccgggttcaagcgattctcttgcctcagcctcctgagtagctgggattacaggagaacggcctcaaggaagactaaccatctgcaatactagaagccatggctgagggatcagtgatgttcagtgatgtgtccatagacttctctcaggaggagtgggactgcctggaccctgttcagagggacttatacagagatgtgatgttggagaactacggcaatctggtttcaatgggactttacactcctaagcctcaagtgatctccttattggaacaagggaaagagccctggatggttggcagagagcttacaagaggcctgtgttcagatctggaatcgatgtgtgaaaccaagttattatctctaaagaaggaagtttatgaaatagaattatgccagagggagataatgggacttacaaagcatggccttgagtactccagttttggagatgttttggaatatagaagccaccttgcaaaacaactgggatatccaaatgggcattttagtcaagaaatattcactcctgaatacatgcccacatttattcaacagacattccttactctccatcaaataattaataatgaagacagaccctatgaatgtaagaaatgtggaaaggcctttagtcagaactcacaatttattcaacatcagagaattcatattggtgaaaaatcttatgaatgtaaagagtgtgggaaattctttagttgtggttcacatgttactcggcatctgaaaattcatactggcgaaaaaccctttgaatgtaaggaatgtggaaaggccttcagttgtagctcatacctttctcaacatcagagaatccataccggtaagaaaccctatgaatgtaaggaatgtgggaaggcctttagttattgctcaaatcttattgaccatcagcgaattcacactggtgaaaaaccttatgaatgtaaagtatgtgggaaagcctttactaagagctcacaactttttcagcatgcacgaattcatacaggtgagaaaccctatgaatgtaaggaatgtggcaaagcctttacccagagctcaaagcttgttcaacatcagagaattcatactggtgagaaaccctatgagtgcaaggaatgtggcaaagcctttagtagtggctcagcacttactaatcatcagagaattcacactggtgagaaaccctatgattgtaaggaatgtggaaaggcttttactcagagctcacagcttcgtcaacatcagagaattcacgctggtgagaaaccctttgaatgtcttgaatgtgggaaggcctttactcagaactcacaacttttccagcatcagagaattcatacagatgaaaaaccatatgaatgtaatgaatgtggaaaggcctttaataaatgctcaaaccttactcgacatctgagaattcacactggtgaaaagccctataactgtaaggaatgtgggaaggcttttagtagtggctcggatctcattcgtcatcagggaattcatactaataaataataaaaattaaagcccctgtcaccttcctcatattttaaaccaaaaatcatgtctaatagttaccctcttccgtagttttttttaaaactttgtatttaaattttgtatccaaatgtatttcattccaggttataaattcggagtctaaagtgacattccctctctcccccagtcatataccgatgccagctgttctataattctttcattcattgttttgttctactttcttggtgacacattatactcatgtttat

SEQ ID NO: 202299 - DNA, 582 bp, Homo sapiens
  Payload ID: 19905
  Gene Name: zinc finger protein 383
  ENST ID: ENST00000588371
  CDS Start-End: 240-582
tttgtgtgtggagacgagagattgtagaaataaagacccaagacagagatagaagaaaagacagctgggcctgagggaccactatcaccaagacacagagaccggtattggccccgaatgcctggtcgcgctgttatttattgtgtataaggcaaaggggcagggtatggagtgagagtcatctccagtgatcggagaacggcctcaaggaagactaaccatctgcaatactagaagccatggctgagggatcagtgatgttcagtgatgtgtccatagacttctctcaggaggagtgggactgcctggaccctgttcagagggacttatacagagatgtgatgttggagaactacggcaatctggtttcaatgggactttacactcctaagcctcaagtgatctccttattggaacaagggaaagagccctggatggttggcagagagcttacaagaggcctgtgttcagatctggaatcgatgtgtgaaaccaagttattatctctaaagaaggaagtttatgaaatagaattatgccagagggagataatgggacttacaaagcatggccttgagtact

SEQ ID NO: 202300 - DNA, 1673 bp, Homo sapiens
  Payload ID: 19905
  Gene Name: zinc finger protein 383
  Uniprot ID: Q8NA42
  ENST ID: ENST00000590503
  CDS Start-End: 225-1652
tttgcctgctggaccctccgcctcaaggatagtagctgtagatccaaaatgacctctgatctgctcagtctgggccacaagaaaggcctggcatctcatcattcctttcttcttcagctctgctctcgtcaagagagttacccagaggaagaatggctgttgaccaaaccaaatacaaggagaacggcctcaaggaagactaaccatctgcaatactagaagccatggctgagggatcagtgatgttcagtgatgtgtccatagacttctctcaggaggagtgggactgcctggaccctgttcagagggacttatacagagatgtgatgttggagaactacggcaatctggtttcaatgggactttacactcctaagcctcaagtgatctccttattggaacaagggaaagagccctggatggttggcagagagcttacaagaggcctgtgttcagatctggaatcgatgtgtgaaaccaagttattatctctaaagaaggaagtttatgaaatagaattatgccagagggagataatgggacttacaaagcatggccttgagtactccagttttggagatgttttggaatatagaagccaccttgcaaaacaactgggatatccaaatgggcattttagtcaagaaatattcactcctgaatacatgcccacatttattcaacagacattccttactctccatcaaataattaataatgaagacagaccctatgaatgtaagaaatgtggaaaggcctttagtcagaactcacaatttattcaacatcagagaattcatattggtgaaaaatcttatgaatgtaaagagtgtgggaaattctttagttgtggttcacatgttactcggcatctgaaaattcatactggcgaaaaaccctttgaatgtaaggaatgtggaaaggccttcagttgtagctcatacctttctcaacatcagagaatccataccggtaagaaaccctatgaatgtaaggaatgtgggaaggcctttagttattgctcaaatcttattgaccatcagcgaattcacactggtgaaaaaccttatgaatgtaaagtatgtgggaaagcctttactaagagctcacaactttttcagcatgcacgaattcatacaggtgagaaaccctatgaatgtaaggaatgtggcaaagcctttacccagagctcaaagcttgttcaacatcagagaattcatactggtgagaaaccctatgagtgcaaggaatgtggcaaagcctttagtagtggctcagcacttactaatcatcagagaattcacactggtgagaaaccctatgattgtaaggaatgtggaaaggcttttactcagagctcacagcttcgtcaacatcagagaattcacgctggtgagaaaccctttgaatgtcttgaatgtgggaaggcctttactcagaactcacaacttttccagcatcagagaattcatacagatgaaaaaccatatgaatgtaatgaatgtggaaaggcctttaataaatgctcaaaccttactcgacatctgagaattcacactggtgaaaagccctataactgtaaggaatgtgggaaggcttttagtagtggctcggatctcattcgtcatcagggaattcatactaataaataataaaaattaaagcccctgtca

SEQ ID NO: 202301 - DNA, 639 bp, Homo sapiens
  Payload ID: 19905
  Gene Name: zinc finger protein 383
  ENST ID: ENST00000588250
  CDS Start-End: 43-288
aacggcctcaaggaagactaaccatctgcaatactagaagccatggctgagggatcagtgatgttcagtgatgtgtccatagacttctctcaggaggagtgggactgcctggaccctgttcagagggacttatacagagatgtgatgttggagaactacggcaatctggtttcaatgggtaagggcatctgtaccagtgattcccagttctcctctggaatgtctccttcttccacagtgaatttctcagctgcttttcaggactttacactcctaagcctcaagtgatctccttattggaacaagggaaagagccctggatggttggcagagagcttacaagaggcctgtgttcagatctggaatcgatgtgtgaaaccaagttattatctctaaagaaggaagtttatgaaatagaattatgccagagggagataatgggacttacaaagcatggccttgagtactccagttttggagatgttttggaatatagaagccaccttgcaaaacaactgggatatccaaatgggcattttagtcaagaaatattcactcctgaatacatgcccacatttattcaacagacattccttactctccatcaaataattaataatgaagacagaccctatgaat

SEQ ID NO: 202302 - DNA, 3266 bp, Homo sapiens
  Payload ID: 19906
  Gene Name: zinc finger protein 384
  Uniprot ID: Q8TF68
  ENST ID: ENST00000319770
  CDS Start-End: 479-2029
gctatttccctccctccccccttttcgtttccggcgctcccgccttctctccgcagagctcttctctgagcctgttggggggagggaggggggcgtggaggaactggggttcgcgggagcacgagctgcagcaccacttccgggtgagtgcaaggggagggcagcaaggagggggggccacccactacctcgcgcccccgccctgcgggtgtctcgcgcgcgttccgtgcgtgtgagtgtgtgggtctgtctcgctccagaagtgcgtgcccgcgcgctgcgccttgcgctttttcccctccctcgccccttcctggtcctcccaccctcctcggctccctcctttcccagcaaacgccgcccctcccgcgccctggctcaggctctggcgccgccgcagccgtcgccgcccgaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatactcactcatcacggccatctttgttgtaaccatttctgtgtttataaatgcattatctctgagaattttcatatttgatgttttgtttatttttgtcctttttttccctctctccacccctgtcctctagccacagcatttttctttttgtcttttttttttttttttaaatcatggcagatttcagaggaaaggaaattaaaaaaaaaatcaggaaaccagttgttataaagtaatttaaaaatgaagaaaaaaagaaaaaaacttatgtacaaaccaaggggtgtttttagaacattgtatagaaataaattcatgtaaaagga

SEQ ID NO: 202303 - DNA, 2514 bp, Homo sapiens
  Payload ID: 19906
  Gene Name: zinc finger protein 384
  Uniprot ID: Q8TF68
  ENST ID: ENST00000355772
  CDS Start-End: 153-1538
agctcttctctgagcctgttggggggagggaggggggcgtggaggaactggggttcgcgggagcacgagctgcagcaccacttccggaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctgccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatactcactcatcacggccatctttgttgtaaccatttctgtgtttataaatgcattatctctgagaa

SEQ ID NO: 202304 - DNA, 2978 bp, Homo sapiens
  Payload ID: 19906
  Gene Name: zinc finger protein 384
  Uniprot ID: Q8TF68
  ENST ID: ENST00000361959
  CDS Start-End: 261-1994
cgcgttccgtgcgtgtgagtgtgtgggtctgtctcgctccagaagtgcgtgcccgcgcgctgcgccttgcgctttttcccctccctcgccccttcctggtcctcccaccctcctcggctccctcctttcccagcaaacgccgcccctcccgcgccctggctcaggctctggcgccgccgcagccgtcgccgcccgaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccggatccactccaagatgcacacggagaccatcaagccccacaagtgcccgcactgctccaagaccttcgccaacacctcctacctggcccagcacctccgtatccactcgggggccaagccctacaactgttcctactgccagaaggccttccgccagctctcccacctccagcagcacacacgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatactcactcatcacggccatctttgttgtaaccatttctgtgtttataaatgcattatctctgagaattttcata

SEQ ID NO: 202305 - DNA, 3008 bp, Homo sapiens
  Payload ID: 19906
  Gene Name: zinc finger protein 384
  Uniprot ID: Q8TF68
  ENST ID: ENST00000396801
  CDS Start-End: 209-1942
gctatttccctccctccccccttttcgtttccggcgctcccgccttctctccgcagagctcttctctgagcctgttggggggagggaggggggcgtggaggaactggggttcgcgggagcacgagctgcagcaccacttccggaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccggatccactccaagatgcacacggagaccatcaagccccacaagtgcccgcactgctccaagaccttcgccaacacctcctacctggcccagcacctccgtatccactcgggggccaagccctacaactgttcctactgccagaaggccttccgccagctctcccacctccagcagcacacacgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatactcactcatcacggccatctttgttgtaaccatttctgtgtttataaatgcattatctctgagaattttcatatttgatgttttgtttatttttgtcctttttttccctctctccacccctgtcctctagccacagcatttttctttttgtcttt

SEQ ID NO: 202306 - DNA, 1286 bp, Homo sapiens
  Payload ID: 19906
  Gene Name: zinc finger protein 384
  ENST ID: ENST00000417772
  CDS Start-End: 154-1286
gagctcttctctgagcctgttggggggagggaggggggcgtggaggaactggggttcgcgggagcacgagctgcagcaccacttccggaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggagcgaagggaactgcggcacaggaaatggacagagccttgggctcatggattcagttcccggctccaccacgaatttgctgtgtgaccctgggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccggatccactccaagatgcacacggagaccatcaagccccacaagtgcccgcactgctccaagaccttcgccaacacctcctacctggcccagcacctccgtatccactcgggggccaagccctacaactg

SEQ ID NO: 202307 - DNA, 1096 bp, Homo sapiens
  Payload ID: 19906
  Gene Name: zinc finger protein 384
  ENST ID: ENST00000436774
  CDS Start-End: 266-1096
tcgcgcgcgttccgtgcgtgtgagtgtgtgggtctgtctcgctccagaagtgcgtgcccgcgcgctgcgccttgcgctttttcccctccctcgccccttcctggtcctcccaccctcctcggctccctcctttcccagcaaacgccgcccctcccgcgccctggctcaggctctggcgccgccgcagccgtcgccgcccgaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttc

SEQ ID NO: 202308 - DNA, 912 bp, Homo sapiens
  Payload ID: 19906
  Gene Name: zinc finger protein 384
  ENST ID: ENST00000535485
  CDS Start-End: 409-912
tcaggggcacagaccctcctcctcctccatctctaatgttctctgacccctggttacctgtggcctgggaacgaacaaggaccagtctctgagcctaggagtgaaacccaaacgctggtgatagaattcgtcttagtttctgggaattggatttatttctcttgtatccacgtagagggtagcactagactgctgttattatatccacccgtctttggattgctggctggggggtctgcctgccttccagactgactgctgacaaataattcctgaggttctccacagttctctggtggctgcaccctgcctggcccctgtaacctagacaatttgtttacagaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggc

SEQ ID NO: 202309 - DNA, 557 bp, Homo sapiens
  Payload ID: 19906
  Gene Name: zinc finger protein 384
  ENST ID: ENST00000544482
  CDS Start-End: 208-557
tctcgcgcgcgttccgtgcgtgtgagtgtgtgggtctgtctcgctccagaagtgcgtgcccgcgcgctgcgccttgcgctttttcccctccctcgccccttcctggtcctcccaccctcctcggctccctcctttcccagcaaacgccgcccctcccgcgccctggctcaggctctggcgccgccgcagccgtcgccgcccggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaag

SEQ ID NO: 202310 - DNA, 572 bp, Homo sapiens
  Payload ID: 19906
  Gene Name: zinc finger protein 384
  ENST ID: ENST00000542351
  CDS Start-End: 219-572
aaggaagggtctttgagaaaggggtaggggacgacatcaggagaaggctcccaggaactgtctcaggggagcgaaggttttgaggggacagctggggtctccagtagatagaccacggtgcaggctgagggaggtacttcttggcacaaggcctcggaaagttcaggagccctggaaaggagaaggaataagacggcaggaggaagagagagagaggaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggt

SEQ ID NO: 202311 - DNA, 1140 bp, Homo sapiens
  Payload ID: 19906
  Gene Name: zinc finger protein 384
  ENST ID: ENST00000540915
  CDS Start-End: 529-1140
gaagtcctcgaagaagtggggggaaggctagaggaagtggctgggcctgaactggcactgtgcctgccacaaggtcttgtgcatcccccagccctcagctttgccttctgaagccactcctcaggggcacagaccctcctcctcctccatctctaatgttctctgacccctggttacctgtggcctgggaacgaacaaggaccagtctctgagcctaggagtgaaacccaaacgctggtgatagaattcgtcttagtttctgggaattggatttatttctcttgtatccacgtagagggtagcactagactgctgttattatatccacccgtctttggattgctggctggggggtctgcctgccttccagactgactgctgacaaataattcctgaggttctccacagttctctggtggctgcaccctgcctggcccctgtaacctagacaatttgtttacagaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctg

SEQ ID NO: 202312 - DNA, 506 bp, Homo sapiens
  Payload ID: 19906
  Gene Name: zinc finger protein 384
  ENST ID: ENST00000538829
  CDS Start-End: 126-506
agagttcagctccctggaggggaaggagggacgtcccaaggaagggtctttgagaaagggaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctca

SEQ ID NO: 202313 - DNA, 500 bp, Homo sapiens
  Payload ID: 19906
  Gene Name: zinc finger protein 384
  ENST ID: ENST00000545946
  CDS Start-End: 1-478
cttcaagtgccacaactgtcatcgggcgtacacggatgcagcctcactagaggtgcacctgtctacgcacacagtgaagcatgccaaggtgtacacctgcactatctgcagtcgggcatacacatcacaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactg

SEQ ID NO: 202314 - DNA, 2076 bp, Homo sapiens
  Payload ID: 19907
  Gene Name: zinc finger protein 385A
  Uniprot ID: Q96PM9
  ENST ID: ENST00000352268
  CDS Start-End: 38-955
agagcgacgcggaaccccgggcgcctgggtccccagcatgatcctcggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccg

SEQ ID NO: 202315 - DNA, 2331 bp, Homo sapiens
  Payload ID: 19907
  Gene Name: zinc finger protein 385A
  Uniprot ID: Q96PM9
  ENST ID: ENST00000338010
  CDS Start-End: 55-1215
agaacggcccccgggacagagcgacgcggaaccccgggcgcctgggtccccagcatgatcctcggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgcc

SEQ ID NO: 202316 - DNA, 2430 bp, Homo sapiens
  Payload ID: 19907
  Gene Name: zinc finger protein 385A
  Uniprot ID: Q96PM9
  ENST ID: ENST00000394313
  CDS Start-End: 210-1310
attgctctggagccagcaggggaagtgtgtacactatgtgcactgagggtgacacttctgagtgtgggggccctggctagggagtgggactggcaggcttgggtggggttcccaagctttaatcttcctaccccacagaatgttttctctgcccttcaggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctcc

SEQ ID NO: 202317 - DNA, 2494 bp, Homo sapiens
  Payload ID: 19907
  Gene Name: zinc finger protein 385A
  Uniprot ID: Q96PM9
  ENST ID: ENST00000546970
  CDS Start-End: 291-1391
gggcagaaccaagggaaggggacgctgtcaggcccaggcccctggggggccagggccaggccactgcctgggggcagcaggcatcagaaactaaaggatgaatcacccacttgactctcttcttcctggggcgataccaagctttaggatcccctgggggaaagcaaaaccagaagaagagggtggccaggggcttgaggctgggagtcctgctggttcagcaggcagcctgcagaaaaggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctg

SEQ ID NO: 202318 - DNA, 1111 bp, Homo sapiens
  Payload ID: 19907
  Gene Name: zinc finger protein 385A
  Uniprot ID: Q96PM9
  ENST ID: ENST00000551771
  CDS Start-End: 160-1017
gacacttctgagtgtgggggccctggctagggagtgggactggcaggcttgggtggggttcccaagctttaatcttcctaccccacagaatgttttctctgcccttcaggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactcccta

SEQ ID NO: 202319 - DNA, 568 bp, Homo sapiens
  Payload ID: 19907
  Gene Name: zinc finger protein 385A
  ENST ID: ENST00000547210
  CDS Start-End: 75-568
attgctctggagccagcaggggaagcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttc

SEQ ID NO: 202320 - DNA, 775 bp, Homo sapiens
  Payload ID: 19907
  Gene Name: zinc finger protein 385A
  ENST ID: ENST00000546919
  CDS Start-End: 81-775
cagaactggacctgtagctgagcattcctggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaacc

SEQ ID NO: 202321 - DNA, 761 bp, Homo sapiens
  Payload ID: 19907
  Gene Name: zinc finger protein 385A
  ENST ID: ENST00000549937
  CDS Start-End: 1-761
cctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagagtctcactctgtcgcccaggctagagtgcagtggcacaatctcagctcactgcaacctccacctcccaggttcaagcgattctcctgcctcagcctcctgagtagctgggattacaggcacctgccaccacacccggtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcc

SEQ ID NO: 202322 - DNA, 477 bp, Homo sapiens
  Payload ID: 19907
  Gene Name: zinc finger protein 385A
  ENST ID: ENST00000550120
  CDS Start-End: 196-477
agcaggggaagtgtgtacactatgtgcactgagggtgacacttctgagtgtgggggccctggctagggagtgggactggcaggcttgggtggggttcccaagctttaatcttcctaccccacagaatgttttctctgcccttcaggcagcctgagccgggcagggcccctgcctctgctacggcagcccccgatcatgcagcccccactggacctcaagcagatcctgcccttcccactcgagccagcccctacccttggcctcttcagcaactacagcaccagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagcccca

SEQ ID NO: 202323 - DNA, 2369 bp, Homo sapiens
  Payload ID: 19907
  Gene Name: zinc finger protein 385A
  Uniprot ID: Q96PM9
  ENST ID: ENST00000551109
  CDS Start-End: 146-1246
ggcagaaccaagggaaggggacgctgtcaggcccaggcccctggggggccagggccaggccactgcctgggggcagcaggcatcagaaactaaaggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccgcc

SEQ ID NO: 202324 - DNA, 545 bp, Homo sapiens
  Payload ID: 19907
  Gene Name: zinc finger protein 385A
  ENST ID: ENST00000550774
  CDS Start-End: 111-545
agaacggcccccgggacagagcgacgcggaaccccgggcgcctgggtccccagcatgatcctcgcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagc

SEQ ID NO: 202325 - DNA, 572 bp, Homo sapiens
  Payload ID: 19907
  Gene Name: zinc finger protein 385A
  ENST ID: ENST00000549962
  CDS Start-End: 38-572
agagcgacgcggaaccccgggcgcctgggtccccagcatgatcctcggcagcctgagccgggcagggcccctgcctctgctacggcagcccccgatcatgcagcccccactggacctcaagcagatcctgcccttcccactcgagccagcccctacccttggcctcttcagcaactacagcaccagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagc

SEQ ID NO: 202326 - DNA, 2099 bp, Homo sapiens
  Payload ID: 19907
  Gene Name: zinc finger protein 385A
  ENST ID: ENST00000550779
  CDS Start-End: 1-342
gagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgcc

SEQ ID NO: 202327 - DNA, 2610 bp, Homo sapiens
  Payload ID: 19908
  Gene Name: zinc finger protein 385B
  Uniprot ID: Q569K4
  ENST ID: ENST00000336917
  CDS Start-End: 244-1353
agtaattagagctaagcggcaattacaggacgtatgatttgttcagaagcactgcctgccggctgtttcctagcaccacatttcacgggagcaccaggttgagatgatggaattatttacttttaaatgtaacatctcgtacagtgctcaaatgcagacgtgaacgtggactgtaaccttaaaaacaaaggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggcccatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttgaattttctctgtaagagaataaaagataaaataatgtattttctttatttcacattttatttggagatatttaaatgaaatagaaagccatataacatagctataattactacctgtttgctatttttgtttaacttattttgtagcttcctcactggtttgtgttgctaagcaaacgtatacaaacagaaaaagagcttcctaaattgcacatttttgcacctcttgtgcattctgcaagaagacaatgaatccatgtatttctatataagtatcttcttcatttttaacctgttttcatttgtaatgatgctacataattttgtggctccctaatgcaataatgtacagaagataaaaaaatttataattgaacaatttgtctttctgttcgctgaatatattgcaggtcatgctcccatgcccccctttctaagccgatatcaacaagactggaatgtttgtgatatcaggggcaagagttatcatagaacaacaaaatagagtggactcttttagagcatctatatctgcaacctgtaaatggtaaaatgtctgtgtatttttttaaatgtaccttttcaataaaagtac

SEQ ID NO: 202328 - DNA, 2750 bp, Homo sapiens
  Payload ID: 19908
  Gene Name: zinc finger protein 385B
  Uniprot ID: Q569K4
  ENST ID: ENST00000409343
  CDS Start-End: 306-1493
agtgcttctggtttcagcacacatggagatatagaattgaaattgctctgctttctttacaaatgactcagagtgtgcttgtccttccctaaaatgttgccagcatgtaaaggattttcaatgagcagtgcaataagccagcaactgggaaggcttggagcggcactgatataacgtggtgctgtcacacagataatcagggctggagccaagtctcggtagcgctgtgcattatcctggtcacatactggaagttttgtttatccaacttggttgctcttgaagctggtgagagccctgccaggatgtggagtggacttcctagcagaggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggcccatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttgaattttctctgtaagagaataaaagataaaataatgtattttctttatttcacattttatttggagatatttaaatgaaatagaaagccatataacatagctataattactacctgtttgctatttttgtttaacttattttgtagcttcctcactggtttgtgttgctaagcaaacgtatacaaacagaaaaagagcttcctaaattgcacatttttgcacctcttgtgcattctgcaagaagacaatgaatccatgtatttctatataagtatcttcttcatttttaacctgttttcatttgtaatgatgctacataattttgtggctccctaatgcaataatgtacagaagataaaaaaatttataattgaacaatttgtctttctgttcgctgaatatattgcaggtcatgctcccatgcccccctttctaagccgatatcaacaagactggaatgtttgtgatatcaggggcaagagttatcatagaacaacaaaatagagtggactcttttagagcatctatatctgcaacctgtaaatggtaaaatgtctgtgtatttttttaaatgtaccttttcaataaaagtac

SEQ ID NO: 202329 - DNA, 2109 bp, Homo sapiens
  Payload ID: 19908
  Gene Name: zinc finger protein 385B
  Uniprot ID: Q569K4
  ENST ID: ENST00000409692
  CDS Start-End: 301-1410
agtagactataagcttttggaaaacagggactatgtcttcttcaacaatgtgtacacaacaagtagcaggttgtttggcacatggcagatgctcgatacgttgatctggcagcggcatgggagatggatccaaagagattaaaactggagtgaaggagtccagtaatgatgtgaagagatgagggtctgaactaggacagaagtcagtcacagggatggatttgagacgttttggagggttacacatgcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggcccatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttgaattttctctgtaagagaataaaagataaaataatg

SEQ ID NO: 202330 - DNA, 3288 bp, Homo sapiens
  Payload ID: 19908
  Gene Name: zinc finger protein 385B
  Uniprot ID: Q569K4
  ENST ID: ENST00000410066
  CDS Start-End: 605-2020
gcacgtccaaaccccggggtcctcggccaggccaggggggcgggcgtgcggcggggccgggccgggccgggcgcgcccagcgggctccgggcacacgcccctcacctgggcgaggcccggtgcgcaggcgctcagcgcgggggcagcggccgggcgcttaagcccggcgcgggcaagagttggacagttcaggggccgcgccgggccgagctgtcgcccgcgccacctccaccgccgccgctgctaccgccaccgccaccgcctgggctgcagcagatcgcgggagaacgtctgcgcgaagccccggtgcagccctggcgggaccgcagcaaccaccggagcgtgagcaacagcttcccggctggaggagccactgccccacgcgcccgcggcccgcgcgccgagatgttctacatttcaactccatcaaatattaaattgatgtttatgggctaacctggaaaccgaaaaacagtttgtttcactacaagaataagaaaatatgtccaaattcctgtcagctgacttataaagggacttttagaacacaacccaatgcatgaggtactccttaagccctgacaaccatcttgaagatggaatcatgaatatggcaaattttctacggggctttgaagaaaaggggataaagaacgacaggcctgaggaccagttgagcaaagagaaaaagaaaattcttttctccttctgtgaggtgtgcaacatccagctgaactctgcagcccaggctcaggtgcattccaacggcaaatcccaccgcaaacgagtgaagcagctgagtgatgggcagcccccaccacccgcccaggccagccccagcagcaacagcagcacaggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggcccatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttgaattttctctgtaagagaataaaagataaaataatgtattttctttatttcacattttatttggagatatttaaatgaaatagaaagccatataacatagctataattactacctgtttgctatttttgtttaacttattttgtagcttcctcactggtttgtgttgctaagcaaacgtatacaaacagaaaaagagcttcctaaattgcacatttttgcacctcttgtgcattctgcaagaagacaatgaatccatgtatttctatataagtatcttcttcatttttaacctgttttcatttgtaatgatgctacataattttgtggctccctaatgcaataatgtacagaagataaaaaaatttataattgaacaatttgtctttctgttcgctgaatatattgcaggtcatgctcccatgcccccctttctaagccgatatcaacaagactggaatgtttgtgatatcaggggcaagagttatcatagaacaacaaaatagagtggactcttttagagcatctatatctgcaacctgtaaatggtaaaatgtctgtgtatttttttaaatgtaccttttcaataaaagtacaaaaaataaaa

SEQ ID NO: 202331 - DNA, 956 bp, Homo sapiens
  Payload ID: 19908
  Gene Name: zinc finger protein 385B
  ENST ID: ENST00000457304
  CDS Start-End: 168-956
cccagtcagttgctgctgctggtcctagggcaggctatctgtgtcgggatgccgagcattactgccactataatcactgaggcatctgccagagatctcatggctgaaaactaggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacag

SEQ ID NO: 202332 - DNA, 501 bp, Homo sapiens
  Payload ID: 19908
  Gene Name: zinc finger protein 385B
  ENST ID: ENST00000439340
  CDS Start-End: 87-501
tagactataagcttttggaaaacagggactatgtcttcttcaacaatgtgtacacaacaagtagcaggttgtttggcacatggcagatgctcggcagtacatgccacactactacccttcctgctcttgtgcgcacacctaccctgatgatgcagccttcactggatatcaaaccatttatgtcttttccagtggacagtagttctgctgttgggctctttccaaattttaacacaaaaagaagaggcttatttgagaccaataaattttgccagatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatc

SEQ ID NO: 202333 - DNA, 404 bp, Homo sapiens
  Payload ID: 19908
  Gene Name: zinc finger protein 385B
  ENST ID: ENST00000438871
  CDS Start-End: 311-404
agggggatagctccctcatcttggatctaggggagcttataacatcttttaaaaggcgaaaattcaagttatctgtggactgtcagaacattttgcataagtcatccccagatgttctacatttcaactccatcaaatattaaattgatgtttatgggctaacctggaaaccgaaaaacagtttgtttcactacaagaataagaaaatatgtccaaattcctgtcagctgacttataaagggacttttagaacacaacccaatgcatgaggtactccttaagccctgacaaccatcttgaagatggaatcatgaatatggcaaattttctacggggctttgaagaaaaggggataaagaacgacaggcctgaggaccagttgagcaaagagaaaaagaaaattc

SEQ ID NO: 202334 - DNA, 565 bp, Homo sapiens
  Payload ID: 19908
  Gene Name: zinc finger protein 385B
  ENST ID: ENST00000451732
  CDS Start-End: 340-565
agggtgacataatggtagaacacagaacacttgtagaaatacttgaggaatgagtctgtgaggtttaatttgtgctaaaaattcatcaacacatctagagcaacgcaaatcttcccaagacagatggagactgttttaagatgttctacatttcaactccatcaaatattaaattgatgtttatgggctaacctggaaaccgaaaaacagtttgtttcactacaagaataagaaaatatgtccaaattcctgtcagctgacttataaagggacttttagaacacaacccaatgcatgaggtactccttaagccctgacaaccatcttgaagatggaatcatgaatatggcaaattttctacggggctttgaagaaaaggggataaagaacgacaggcctgaggaccagttgagcaaagagaaaaagaaaattcttttctccttctgtgaggtgtgcaacatccagctgaactctgcagcccaggctcaggtgcattccaacggcaaatcccaccgcaaacgagtgaagcagctgagtgatgggcagcccccaccacccgcccagg

SEQ ID NO: 202335 - DNA, 1380 bp, Homo sapiens
  Payload ID: 19909
  Gene Name: zinc finger protein 385C
  ENST ID: ENST00000436535
  CDS Start-End: 2-1380
tatgaagcggccactgagcccacccccaccggctgagaaggagacccccatatctggagctgctgagtgcctccctcggcccccagaaccacctaagcccaagcgagaaagaaagcggccatcgtacacgctctgtgatgtctgcaacatccagctgaactcggcggcccaggcccaggtgcactgtggggggcgggcccaccagaggcggcttcggcagctcagcttggggaagagcccctcagggccagcaggcccggcctccggcgcccccagccccctgctggcctccctgcccctgcccacccggcctctgcagcccccgctggacttcaagcacttgctcgccttccacttcaatggcgctgccccgctcagtctcttccccaacttcagcacgatggacccggtccagaaagctgtcatcagccacacgtttggtgtcccctcccctctgaagaagaagctgttcatttcctgtaacatctgtcacctgaggttcaactcagcgaaccaggccgaggcacattataaaggccacaaacacgccagaaaactcaaggctgtcgaggctgccaagagcaagcagaggccacacacccaggcccaggatggggctgtagtgtccccaatcccaacgctggccagtggagcccctggagagccacagagtaaagcagttcctgcagcccctcctcttgggcctccactccagccaccaccaactccagaccctacatgcagggagccagcccactcagagctcttggatgctgcctcctcatcctcttcttcctcctgcccaccttgctccccagagcctgggagagaggcaccggggcctgagccagcggcagctgccgtgggaagcagcatgagtggggaaggcaggagtgagaaggggcacctctactgccccacgtgtaaggtgacagtgaactcggcctcccagcttcaggctcacaacacaggagccaagcaccggtggatgatggaaggtcagcgaggggctccccggaggagccggggccgcccggtgtccaggggaggtgccggacacaaagccaagagagtcacagggggccggggcggccggcaggggcccagccctgccttccactgtgctctctgtcagctccaggtcaattcagagacccaactgaagcagcacatgagcagcaggaggcacaaagaccgcctggccgggaagacccccaagccctccagccagcacagcaagctgcagaagcacgcagcgctggcttctaaactggccttgcagaagcaactcaccaagacgttggcagcccgcttcctgcccagcccgctccccaccgcagccactgccatctgtgctctgccagggcccctggccctccg

SEQ ID NO: 202336 - DNA, 2596 bp, Homo sapiens
  Payload ID: 19909
  Gene Name: zinc finger protein 385C
  ENST ID: ENST00000618554
  CDS Start-End: 1-1275
atgggtctggctgcaggcccggcctccggcgcccccagccccctgctggcctccctgcccctgcccacccggcctctgcagcccccgctggacttcaagcacttgctcgccttccacttcaatggcgctgccccgctcagtctcttccccaacttcagcacgatggacccggtccagaaagctgtcatcagccacacgtttggtgtcccctcccctctgaagaagaagctgttcatttcctgtaacatctgtcacctgaggttcaactcagcgaaccaggccgaggcacattataaaggccacaaacacgccagaaaactcaaggctgtcgaggctgccaagagcaagcagaggccacacacccaggcccaggatggggctgtagtgtccccaatcccaacgctggccagtggagcccctggagagccacagagtaaagttcctgcagcccctcctcttgggcctccactccagccaccaccaactccagaccctacatgcagggagccagcccactcagagctcttggatgctgcctcctcatcctcttcttcctcctgcccaccttgctccccagagcctgggagagaggcaccggggcctgagccagcggcagctgccgtgggaagcagcatgagtggggaaggcaggagtgagaaggggcacctctactgccccacgtgtaaggtgacagtgaactcggcctcccagcttcaggctcacaacacaggagccaagcaccggtggatgatggaaggtcagcgaggggctccccggaggagccggggccgcccggtgtccaggggaggtgccggacacaaagccaagagagtcacagggggccggggcggccggcaggggcccagccctgccttccactgtgctctctgtcagctccaggtcaattcagagacccaactgaagcagcacatgagcagcaggaggcacaaagaccgcctggccgggaagacccccaagccctccagccagcacagcaagctgcagaagcacgcagcgctggctgtgagtatcctcaagtctaaactggccttgcagaagcaactcaccaagacgttggcagcccgcttcctgcccagcccgctccccaccgcagccactgccatctgtgctctgccagggcccctggccctccgccctgcccctacagcagccactaccctcttcccggctcccatcctgggcccagctctgtttcgcaccccagcaggagctgtccgccctgccacaggacctatcgtccttgccccttattagccctcatggggaggccagagctgatttcccaatagccactccttgtctcctcctgtcctgagacaccttggtttcctacatgccacagggactgtgaacagcttcaggggtcctgcccgatccagaaagagctgggctagttttaagggcagctgccttccaaggactgtccccaccctcctttcgcaggccttccagggttaatcctaggcttgcctgcatttcccaccctgacagaccccaaagatctatgcaaaatctcagccccagccatgtggtgctctcactttcctccacccaagacccacatggccagactctaggaatcttagcttctacaagccatcctctcctagccaggggacgactctctgacctctattcctaggctttggggcttcactggagatagggatggggtctctagctgcagcaggctcaaggctgtcaggacaaggtgaccatgggagtgtgacagaggaccatggaggagaaagggggacccaaaagtccttcgatcagcagtgctaaggtggggcagagccaaggaggtagtggggctggttctgaaagcttttgggggcttcatctgctctgaaggggtgggactaagagaggaggtgatgttctggttgggcccagggttttgttttaatcttaagtcttctgggcattcatgggcccagtctttttttctgtctgagagtatcattctgttgcccaggttagagtgcagtggtgcaatcttggctcactgcatgcagcctctgcctccctggttcaagtgatacttgctgataagcccagtcttaatattgagggagtaactcatccctcagaagctcttcttcttagcctttctctgacttcctgaaccccaactcttggagggcgggtgtgggtctccctcagactatggactcagctaacaccgaaccccccgcagagctcccaaaggaagagctttcccctacagcttcccactccaaactggtcctagcactaaattcagctttcccttctcccaaccagcccctgccactgtgaagctgagtgttgggaggcagtctcacatgcactggcaagacccattttcatgctgtcaatgtcaatgtcacaaactcctttccactgcagcactgccccctccccaccccacaatatgggaccctgccagtatccccctgtatcttttttttgttttttaaagacatttccaatgggagaaccagaaaaagggggaggggagggaaactttttgataacaattgtggttttattgtgtccaaccaatgcatcaataaatgaacttgaagcccaa

SEQ ID NO: 202337 - DNA, 10699 bp, Homo sapiens
  Payload ID: 19910
  Gene Name: zinc finger protein 385D
  Uniprot ID: Q9H6B1
  ENST ID: ENST00000281523
  CDS Start-End: 520-1707
acagtggtgaatttctcctgtgtgttcctgtgtggatcccgacactcttctcgctttaagagagcctcccgcgcccctcactccgccccttcccaagtctctgggctcgtcaaagcttcccgagagccatggttggtccaggcaggcagtcggagcacctcgtggagcggctgctaacccagggtggggtggggtggggtggaggggtctgcttgtagtactctcagtcctgatgtcacaggcgcggcaaggacatcgcaaggaggagtcggattacagtaaggatgggcagtgcagcaggcagcccgagcgcactctccagccgccggggatcttagccctggaaaggcagcctgcaaggcgctcatcccgcggaggaggcacgctctcggcgctcactgctctccacgccggggacatttccaccgaatgtagcatgaaagggctctgctctacgtgccagccttgggtgagagctgatgctgaagacaccgcggtgggattccagctgtctgattaatgagaaacataatgtattttggtggtacatgccagagtcctgctctcccggcccttgtccgtccaccagcccctcctttgcaaccatcgctggatattaaaccatttcttccctttcctcttgacactgcagctgcagtcaacctcttccccaatttcaatgcgatggacccgattcagaaagctgtaataaaccatacattcggggttcctcttccccaccgaagaaagcaaatcatatcatgcaacatttgccagttgagatttaattctgatagccaggctgcggcccactacaaaggcacgaaacatgccaagaagctcaaagcactggaagccatgaaaaataagcagaaatctgtaactgccaaggacagcgcaaagactaccttcacctccatcactaccaataccatcaataccagctctgacaaaacagacggtactgcagggacaccagcaatatcaacgacgacaactgtggaaatccgcaaaagcagtgttatgacaactgagatcacctctaaagtggaaaaaagcccaacgacagccactggcaatagctcatgtccttctactgagaccgaggaagaaaaggcaaaacggcttctttactgttcgctatgcaaggttgctgtcaactctgcctcgcagctggaggcgcacaacagtggtactaagcacaaaaccatgttagaagcccggaatggaagtggcactatcaaagcctttcctagggcaggagtgaaaggcaaaggacctgttaataaaggaaacacaggcctccaaaataaaacatttcactgtgaaatctgtgatgtgcacgtcaactcggaaacgcaacttaaacagcacattagcagtagaaggcacaaagacagagctgctgggaagcccccgaaacctaaatacagtccttacaacaaactacagaagacagcacatccactgggggtaaaattagtattttcaaaagaaccttcaaagccattggctccacgaattctaccaaatcctctagcagctgcagcagccgcagcagcagtggcagtgagttcccccttcagtcttcgaactgctccagcagcaacactgttccagacttccgcgcttcctccggcactcctgcggccagctcctggacccattcggaccgcccacactcctgtgctgtttgctccttactaaattccaaataggagtaattgtactgcaataatttttcaaaaaacaaaaaacaaaacaaacaaaagagaactatgcagtgtttatttatagtttaaagtatatctgaagagccaggacttttgatagtgaattgaaaaggttataaaaaagtgggggaggtttgggggtgggagggagggagtggtattttctccaaattaaagcattcctcttgaacgctgattgttttagaagtgatctccagcattgatttgtagtggtatctagaccttctgaagcctctgtgactgtgcttttgggcacctatttccctctgcattgtctgtcctgctttatgaaacaactatacattgtctaagggcattaactggttccaatgtatataaaataatttactctgtagattaaaatcgtacaaaaaaaaaggaaaaaaacaaaaacaaaagcaacactgtgaatagtactacccgtgctggtcctcttgctatgacggcaattactgggtatttatcccaacaaaagtagatacagtagatgtcttgtaaaacaatagtgctgtgtctcaatctatgccactaggttttaaagaattgcaaaggtagaatgaacaactatttcataccaataagcagtcaaaaaataaacatacaccggatggtgtcatggaggtctccctggtcagcattctcccctcctgtctagcttgaagatataacagggctaagcttagagatgggggaggcattaataaaggtgatttcttataaagtagtaacttcccaccctgaagatatattgctggaaacagggaagtgtttataatgaacctatatctgaaagcagagaaacccatgcatcatgagtgttaagaaagaaatcaatacaactcttctatttcaaggatgaagaatcataacctagaatgataatgcaaagtaaagatctttcatttagtacatatccagtaaaaacggagaatgttgcatctctgcagtatcccctttatatcataccagtagggttgtttcttaggcaaaggtttctgctttaagtatgatggtagaattaagcattagctatttttatgggtttttcttgttttttagattacctgctgacatgatataaacaattaatatatatttaaatgttaataacaacaggaaatatgaatctgagttaattgcacaccaatgacatagtgttaaaaaatactggtaagttccactcgacaattatttctccagtggagttgtgaaatactgagagcctttgatattcaccatcaggctgaaagaagttgatgttttacctttaaaacaagatttatcaggggtatatataaatatatgtatattgtatatatgttagaaagattaagagaataagttataaaaagaaaaaatctatataaaataattatataaccatccagtgttacatgttatcattaaattggtaacaaatggcataaaaatagctgtgcctttaatttgtgataaaggctatttgctttttcccatagaaagctgacatatacctatcaaaatggtggggtttgatgcagccagtctgttgcattaataagagcaatgacactgaaacttagaataatgacaaaacatacatgatttaggtttagagaaaaaactatttttgaaaaggttttctaaagactatttaaaaatatagggaaggattgggtgtggccttcctgaaactgctctcaaagtgttgtaacccttggagaggtataaagaatcaagaggaaaccatttgagacataggtatttagcatttatcattttatatttaagaaacaccatagcgtgcttggtgctcaacattaaacatggttttttggagttcttctccaccatctagctatagaaatttgtcatataaatgaatctttaaagcagttggctttatatatcctttgttaaccaaccaaaacaaaaacaaaaaaaaagaaggaaagaaggaaggaaggaaggaagaatggaaggaaggaaggaagaaaggagggaaggaaggaaggaaaggagatggggaagggaagaaaaggaaggaaggaagaaaggaagataatgtgttccatcagtattctggtagaaagaatttcaaaccatgcttctctggttaaatatattgattagcattaaaatttgttttgaaagtatctggtgattttgcatttaccagcatctctattctctagttttagcaagtgtttcctttttcacctacagaccctggtagttcagccaggtggatagttgcccataagtctgttgtttggggctctgtctgtatcccatgtgaccagcttctaaccattttgaactttagtttcccttttctgctatgtcaaatattttgattttccataatcatcctgagtccctatccaacaacctttacaactgatacagcctcactttctgttagataacttagtgttaattaaagcagtctcactaaaacgtgcttttgctgttctttcccattttcaccaaagtgaatgagccagtccactaaaaatcagggcctatgggatacacagtgtcctgggtcacaaggcattactgtctttaatgatttgctgggaacaaacgaatcagccatattttctccatcagccatataagaaatctcagaaatacctggatcccttctgcctcacttcgctatggaaccatttttgtttaaatggtcttttaaattggagttgtaagcatcagttgtcttttattcactacctaataaaggatgaagcctaaccacagaacttacagtggattctctgtgagttgtttcccccacactccatatatttaccaataccagattaacatccattatagttcaggctgccataaaactgtatcttttcccttagggaacttttttcatgaataaagatccacaatttagattggtcagcagtgtgctgtgaaaatccctgagggtggtctgactttatggttttacattccttcccatgcatcacaccatggcaaggaaagtgatagagaaagcagctctgattcatttgaaacaaatataaatgcattgcagaagccaaatgcctctggaaaaagcattgttgcacctcaatcagatcgtccagacaaatgggaaacagtcattggggaggtactgtatttctcttatgagaaaacaggcaattacacatgataaattgctcctctcactggacctcaactttgaagagtactttttttattcacataagcaaacatacttggcttttggcaatttatatcacccctgcctcatttgaaaggatttctatctttaggtactatttggcttctcctgatctatcgcagtaattcactgccattatcatcagagatgaaatttggtttttctaaaggtgctacatattttgttgccaagaaactagttagcaaaggagtatttatatgtacttgaaaattaaaagagcaggaaatcataaaagactaagaattaaaagacagcagaagtttcaaaatagaatcaaagaggctgtgcctatttgagtttctaaggcacaaaccaacacatagtagacatgagcaataaatatcaccaattacaattaaattttaaattaatatctttgtctttgtaccagtgtaatgtttcaattgttctgaagaaatcagatcagaaagctaaaaggtaactgaagtggtatataggcctgtttctttagatctgaattgaagtagaaaattacctttctatacataagcatggatgacattgtattaataactttgttcacccaaaagccgcatgaagtggtgggaaaagcaatgaggagccttagagtagccagagtctattgtagactttgtccctgaccaacagggtaacttaaatagtcaactaatgccttgcccttaatttcttcatcagtaaaatggatgacagtgattaatagctaagctggtttaatacatcagcactagaggggcattgcttttatcctctcaggaataaaaattctttattcgagtgaccaatgcagctactcacatacttgcatatgtccagaaaaatattctgtattcctttccatcctgagtgtaagccatattgtaggtcattcatatgctcaaccagaatgtacatttcaccaatattggagtagttgctaattcacttagtactcacttattatgatcgcacttatgccaacatcatgtaagatatgctacttctattttcccagtcaagaatgtaataaattctgaacaaaaccaaccctgaaaaaggcaatagacagctggcagtgggggtgtggaagggaacaacaatttaaatgcatcatccttatttcttttgttgcactttctctcttcaataggaaggggtcccgactaagccataactaattctgtcctgcgtttgcatgtattttaactaatggttgccttattaagaccatctcttccacagacaagtatatcagttatgcgctcttgtcattgttacaggaattatttaaactgagtcctaacagtgaaagttttacctgacttttgctgatttttttttctttctacatggggagatttatctctggagcatctcttgtgtttttgtatggtttgcttcagtagctagagaggctactatcaggaagtgaaatggatcatttctaatggtaggtctccattgcctacatggtatttctgagagtggtatcagggtgtccagtgaaagacggataggttgacatgtcatgctcatttggcctaaaggttgttactgccaggaatggacttacaacttaccagaatgtgaatggtgacaaaaggcaggttctactctggaaaaatatgtgttattttattagaagttcatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaagaagttcatgcaggtcatgaagagtcacagagtttaaagaattctctggttgggtcatcaatgttcagatgtcaagggactgaacattaccttcaatttgagggtcttctctttcctcttctcagtgatggaaactcatccttcctaggtggctaagttgactgtagaaactgctaaaatgtatttgtcaaacgaagtaaaatctgactattaatatatatgatcaggtagagtatcttagagtttggttaactaagacagccgataatggggtcatgttattttcagactggcaggtcatctctaaaggcaatttttaaagattagggctaaaatgatttgtgagcaaagaagtataattaaaaataagtaatagtatagtgacgagttctaaggttaatgcttatatacgcacacacatacagaattgtaaaaatatgagtcttagtacctgtcattcttttacaaagccatggtaaaatcattttattttcaatgattaggttggttttactttaacaaaaggaactccaatgtcacacttgggagtcttaatcattttggggcattaatcattttagggcattggaggggctgggaagtagatataatgttaagatgttatgcactctagcaagactattatgctaacagtttgagttgggtcatacaattgtatcatttcacatcagctactgactttgagtactgactttgaatgcttataaaatcttcctcaaatccaggtagtgtgcaggacatggtataacaagacaacggaaaattagcagagagagccttcattggaaacccagattgtatttttgccagtacaacaaatattatttttaaagtctctcactaataggattgttcaacataaatctattgagaaacaatgatgtcagagagttttaaagctatagtgaagtgtgttaaattttgttaaccaaaataatgatatgggttttattggacgtttgtcaacccaacttaacacacattgttatataatttcagtataggaccctagggctaggggcaactaatattggataaagacccttcgtgagatgctttatgtctcttatgatgttatgctaacattagtagagatgaaaaaggaattgagttcgtgagatcctggaaagtttaacttttatcaaatagtcaagaaaaattccattttatggcatctggtttttaaatggattatagaaaaatgtgtggaagtactggatattggcgaaaaagccttgtggccaagggatctgggcacaagatcgagcatcacagaacagtgaacacagttgttggcttcactaccaatcatctacgaggaaactgggccaattcacttgacattttgatgattctctctgataaaaatagggataatgactgattacagaaatgtgcttttaaaaaagctgaatttagtaaaagcaagtcatttgctactcaaaatagctccaaaatctaagccatatttctataaatttcataaagtcgttttaaaatgtgacttatagttacagcgtttatattactacatatttaagatggaactgacctgatgccaaagctacatcatttgtagctatattagctttctcttttgtcctgaaaaaaggttggagtgtttttaaaaatatagtttttaatctgcacatggagctatatgcaaagaacattgtttcttcggggaatatttttagtcatagtttctttcatttattttatcagcaaaaatcttatgtcagtttcaactaaggtctcctaactgaacttttttttgttttgttttgttttgttttgttttgttttgtaaatccacagcaatttttattaaataaaagcctaggtgagaaaaataagttatatcctagcacatgaaacttagtcaataatttcttctaataatatttaattcactgaaattttacaacaaattttaaatcgactaccaagagtggtcagtcggggaaaatttagtgttatccaatgtatgatgaaatattcagctctcacaaaaactggatgtttggctattttaaaatggctgttcttcacaataaaactacaaacagacactgtcgaataaattgagtgataagtatgtctatttactaacatgagccaatttgaactttagttttgagatctaaaaatattttaatccacatgcatttagtgactataaattgaaggcagtgttcttttgacaaccaagcttattgaaaactttggcattaatgttcacaaacatgagcactattttgaaattaaaaatagactatggtttgctctacatgcttgtgaccctgcaaaaaataaaggaaaaatattcatgctatttttctcctcttatattcttatggcttaaaaaatataaccagggttttatctaatatcaatctcttggcaaaggatcatataaggttttacctgctaacaagaatacctcatttgaaagagcattaccacaagcattggagggaggtacagttgacatggtgaatttgattttacaaaaactaacaaagctggggggtggcaaagcattgacttaactataatcactagtcacaccaatgtgagattccgaatcattggtcagccacagtgatgccaccttggcatcaaacttgcctgttccatctttatcaatgtatctggaagtctgacttgagtaccagaagccaaaacgctcagaatgctaatttgtgccaccttaatggcccatgtgttcggtaaataaatttgctttttacatctcgtcaaatcttactgaataaacctttcatcagagttctacatatccccaggtgggcttggaaacgtgagataggattttattgtgttttatattatgatagttgaatgatgattctatatgttattgttatatttgttttcattaaaaacccaaagaactaccctttgtataccagtaaagtactattttttcttgaaaaaaagtaataataataataattaaggcaattcacatagtttgttttatgccagtcttctgttttaagtcatgtgataacatctccccaaacatcaatttctcaccctacatgatatgtgataaaatcccccatatgccaataatttcccccactataaaatgaagctgcttccaatattattgactcagaaatgtaaaatatagcacagtttatcttgtctgtggtcctgtactaagttaaacttgcagctgtgaacaaattaatatttatttttattaggaattctttaagatgaattttcagttttagtaaaagaaagacaccagtgatatttttatggatgaaagctctctggttccttcagcagctctaggaacatccttagccattatatcctctctctttgacaatatcaaaattgtccaggtaaatgtaatattgccagtggtgtcaagacattggtctgttcatgtccttattcttcgcttggtttgtggaatcaaaatggttgcttattttcctctcttctgtagataatccataggcaatgttttcaatttgggaaactttttttttcaacttggtttaagtttgaaggctctaaggaagaggaatattagaacaaattatgtattctctatgttctattccacttgtttgtaatatactcctgttctgagagttatggtaaacctatataacacgactgttccaagtgccaagtgagaattgtagtgactcacagaacacgtctcatgactatttatcaaaagaaatgtgctgattaaagaaaaaaagtaaaatatcttattttca

SEQ ID NO: 202338 - DNA, 900 bp, Homo sapiens
  Payload ID: 19910
  Gene Name: zinc finger protein 385D
  ENST ID: ENST00000446749
  CDS Start-End: 199-510
gccgccggggatcttagccctggaaaggcagcctgcaaggcgctcatcccgcggaggaggcacgctctcggcgctcactgctctccacgccggggacatttccaccgaatgtagcatgaaagggctctgctctacgtgccagccttgggtgagagctgatgctgaagacaccgcggtgggattccagctgtctgattaatgagaaacataatgtattttggtggtacatgccagagtcctgctctcccggcccttgtccgtccaccagcccctcctttgcaaccatcgctggatattaaaccatttcttccctttcctcttgacactgcagctgcagtcaacctcttccccaatttcaatgcgatggacccgattcagaaagctgtaataaaccatacattcggggttcctcttccccaccgaagaaagcaaatcatatcatgcaacatttgccagttgagatttaattctgatatggcacaagcaaaagaactggattggccccattaggtagtacaaacacactggagcctcccaacaatggactggggcatgaaagatccatgcgctgaaaaaatgacactaagttgaacttctcagactacccttgagccaggctgcggcccactacaaaggcacgaaacatgccaagaagctcaaagcactggaagccatgaaaaataagcagaaatctgtaactgccaaggacagcgcaaagactaccttcacctccatcactaccaataccatcaataccagctctgacaaaacagacggtactgcagggacaccagcaatatcaacgacgacaactgtggaaatccgcaaaagcagtgttatgacaactgagatcacctctaaagtggaaaaaagcccaacgacagccactggcaatagctc

SEQ ID NO: 202339 - DNA, 4079 bp, Homo sapiens
  Payload ID: 19911
  Gene Name: zinc finger protein 391
  Uniprot ID: Q9UJN7
  ENST ID: ENST00000244576
  CDS Start-End: 546-1622
agcgcagagctgcgaccgctgctgatacgttgctcagtctcagtgtggtctctgttttgcaactggtcgtccgcgtcaggagacttaggtccaggcgactgcccagacaatgactggtcccgcataccgagcagagcatgatcagcagcagtctgagtggaagagtgcctgtgatcttagggaacctgatgggcgttggagcagcggttcgacgcatgggtttctctttaatccttccgacttccccaagcccagcgcactcaggttccgctccaagtgcgggacccgcccggggtgtgtcgggggtactcggccggaggcggccggtgagtgaggcttacagggccccgggaccaaggaaccccagcatgttaattgaacttgatcacccagttgaaggaagaataatagtagatgttggatcttcaggaagctgaagagggcagtgcccagaaatacctgtcttgatagggggatttgagctgaaccaaagcatcaacaccaatcagactgtttccgaagaactagagttttctgggtcagcaatggaaagcctcagagggaatactgctcagggtcctacaaatgaagaagactataaaaacgaaggccaattatcaaggcaaacaaaatgtcctgcacagaagaaatcctcttttgagaacacagtggtcagaaaagtgtcagtgacactcaaagaaattttcacaggggaggaaggccctgaatccagtgaatttagtctaagcccaaaccttgacgcacaacagaaaattccaaagggacatggatccccaatatctaggaaaaactccaaagataattcagacttaattaaacaccaaagacttttctcacaaagaaaaccttgtaaatgcaatgaatgtgaaaaagcctttagttaccaatcagaccttcttgtacacagtagaattcatggtggagaaaagccttttgaatgcaacaaatgtgggaaatctttcagccgaagtacacaccttattgaacatcaaagaactcacactggagagaaaccttatgaatgcaatgaatgtggaaaagcttttagccggagcacacatcttagtctacatcagagaatccatactggagaaaaaccatatgaatgtagtgaatgtggaaaagcctttagccgaagcactaaccttagtcagcatcagcgaactcatactcaagaaaggccttacaaatgtaatgaatgtgggaaagccttcggtgaccgttcaaccataattcagcatcaacgaatacacactggagagaatccctatgaatgcagtaaatgtggaaaagctttcagttggatctcatcgcttactgaacatcagagaacacacactggggagaacccctatgagtgcagtgaatgtgggaaagtgttcagtcgaagctcgtctcttacagaacatcagagaatccacagtggagaaaagcctcacgagtgtagagtgtgtggaaagggcttcagtcgaagctcatcccttattattcatcagagaactcataccggggagaagccgtacaaatgtaatgactgtggaaaagccttctgtcagagttcaactctgatcagacatcagcaccttcatactaaagagtaatatctgagcttttattaatgttagcataagaacacatatacctaacctcccaccactgaaatatatatatttcaagtatatatatacttgttctaattttcttttattagatacctatacccgttttaagctttcattcgttctttccatccatctatccttctttcgtctcccctcccttcttccctccttccctccttcctactttttctccctctccctgttctttctttctcttttctcaaataagttcacaataaaacaaagggatgactcaaaaaacataacatatgaaatctaatattctgaagggctccaactttagagtataaagctatctgacaccttgtagtttctctgctaatctattccttcaagcgtgggtccccgaaccaccaggttctcctctgttttctaaccacatcagcccctgcacatgaagagaaaatcctgtgtgtgtgtcttcatacttgctggctctagtaccagaagagagggatctggcttcagagcaggactgaaaacttctcaccagtctggggataatagtgttgaggcaaattcattctcttgacttgcaaaaacagatttttctcatcttcctccttctctcaccttttttgcagtagcatttttcctcaaagtacaactcatttttttactaacgcctaactaatcctagtgttattttatcatatttttaccaagaatgttctaaaaatcttggagacgttcctccatgatcttgggaaaaaaagttgccaaatgctgtgctgttttttttgtttgtttttaattttctttcatttacagatttcatgaaacttatattctgtggctttgaccctcaccaatcttggaagattgatctctcaaggacaaacccagtgcctatttctcagtcctttttctacttgacatttgcagaattggcactttttgccactgttatgccttaaatcttgagcttctttcaggatccatgattctgtgctgatctacacttttcctacctctcagcatttctttgattgtcaatgatcagctctgtgatttggggcaagggttaggccagaattatctcattttatcaagttataaaacttgaggtagtgcaactagattatacacttcttgaagacagaaatcttggtttgtttgttgttttatttttgagagaaggtcttgctgtgttgcccaggctggagtgcaatggcacaatcatagctcactgtagccttgaacttctgggctcctgccacagcctcctgagtagctagggctgcaagtgtgtaccaccacacccacaattttaaagtttttttgtggagacaggatctcactatattggcaaggctggcctccatctcctgaactcaaacaattctcccacctcggcttccgaaaacactgacattacaggtgtgagccaccacacctgccagaaatcttgtttttgattgatataaaacatcacaaagtactgagtagacactaaatgctctgtaattattgctcactgattcctctttatctgtaatcaatcaacttgactttatttgatatggattaataattgatttctttctctctttctactgctgcttccaagttcttggtaccttgtgcctagattactaaattgatcactgttgactcactaccattatctagctccttactaaactactactttgttaaaaaaaaatagtcgtttcccagtgacctctgccccaaatgtaaacttctttaacctaaaggtctttcatagtttgatctacttacttacttcctttctcttctcaaagataatacatgcgggcaggcctgttttgtccctactataccctcttctcacacttttcttcttttcaaactgttccttggcacttctacatgtcctactttcttcgttgtattccagaaaccctatccacccttttttaaaggccatgctcatatcctggctctgtgacactttcagtcccctgccttcttagaaatcctttgtagtgatggtttgcattattctcctgtattagacaccttctttactgttttctggttctttcacaagtacttttttacataagctgttttgaagttgtaaatcatcctaaatcttttataagcctcatataatacatagtacaatgccagcctggactctagttttaatctaaatacatagggtttaatttagcagcataatctttttagtcttttgaatgatgaggtaacctcataggtattttggcccattttgtttttccttgaattacatatataactgactatttagactgactcctttagatctcctgggatgctgacctcttggctttccaattcatgagactattgtaaagaataagtgagttcattcatgtaaagtagtaaaacagtgcctgacaaaagtaaatgctcaataaattctaattgttatgattctagtga

SEQ ID NO: 202340 - DNA, 749 bp, Homo sapiens
  Payload ID: 19911
  Gene Name: zinc finger protein 391
  ENST ID: ENST00000461521
  CDS Start-End: 351-749
aagtgcgggacccgcccggggtgtgtcgggggtactcggccggaggcggccggtgagtgaggcttacagggccccgggaccaaggttcataggtggaagaaattcatctccagatgagactttggacttggacttgggacttttgagttaatgccagaatgatgaaccccagcatgttaattgaacttgatcacccagttgaaggaagaataatagtagatgttggatcttcaggaagctgaagagggcagtgcccagaaatacctgtcttgatagggggatttgagctgaaccaaagcatcaacaccaatcagactgtttccgaagaactagagttttctgggtcagcaatggaaagcctcagagggaatactgctcagggtcctacaaatgaagaagactataaaaacgaaggccaattatcaaggcaaacaaaatgtcctgcacagaagaaatcctcttttgagaacacagtggtcagaaaagtgtcagtgacactcaaagaaattttcacaggggaggaaggccctgaatccagtgaatttagtctaagcccaaaccttgacgcacaacagaaaattccaaagggacatggatccccaatatctaggaaaaactccaaagataattcagacttaattaaacaccaaagacttttctcacaaagaaaaccttgtaaatgcaatgaatgtgaaaaagcctttagttaccaatcagaccttcttgtacacagtagaattcatggtgga

SEQ ID NO: 202341 - DNA, 2179 bp, Homo sapiens
  Payload ID: 19912
  Gene Name: zinc finger protein 394
  Uniprot ID: Q53GI3
  ENST ID: ENST00000337673
  CDS Start-End: 205-1890
gcttccggcacgggatgttttcggttgtttgaccgagagagttgtaggcgcaaagctgaggaaaggagagtgtggagaggggcctggtgtggtggggcccggtgtttgggaccggagggtgttgacggctgatgagttccttgggtttgctctttcttcacctgaaaagaagactccaggaagggcagcacatgccggagaaagatgaattccagcttgaccgcccagaggcgcggcagtgacgccgagttgggaccctgggtgatggctgcgaggtccaaggacgcggcgccgtcccaacgcgacggacttttgcccgtgaaagtggaggaagactcacccggaagttgggagcccaactatcccgcggcttcgccggaccccgaaacttctcgactgcactttaggcagctgcgttaccaggaggtggctggaccggaagaggcgctgagccggctccgagaactctgtcgtcggtggctgagacccgagctgctctccaaggagcagatcctggagctgctggtgctggagcagttcctcaccatcctgcccgaggagcttcaagcctgggtgcgagagcactgcccagagagcggggaggaggcggtggccgtggtgcgggctctgcagcgagcgctcgatggaacctcatcccaggggatggtgactttcgaggacacggctgtgtctctaacctgggaggagtgggagcgcctggacccagcacggagggacttctgcagagagagtgcgcagaaggattccgggagcacagttccgccgagtttggaaagcagagtggagaacaaagagttgattccaatgcaacaaattttagaagaagcggagccacaggggcaactacaagaagcgttccaggggaagcgccccctgttttctaagtgtggcagtacccatgaggacagggtggaaaagcagtccggagaccccttgcccctgaaacttgaaaattctcctgaagcagaaggactcaacagcatctcagatgtcaataagaatggttccatagaaggggaagactctaaaaataatgaattgcagaacagtgccaggtgttccaaccttgttctatgtcagcacatcccgaaagcagagaggcccactgacagtgaggaacacgggaacaagtgcaagcaaagtttccacatggtgacgtggcacgtgctgaaacctcacaagtctgacagtggagacagtttccatcattccagcctttttgagacccagaggcagctccatgaagaaagaccttataaatgtggtaactgtgggaagagtttcaaacaacgctctgacctctttagacaccagagaatccacacaggtgagaaaccctatggctgccaagaatgtgggaaaagcttcagccagagtgctgccctgaccaagcaccagaggacacacacaggcgagaagccgtacacctgtctgaaatgtggggagcgcttcaggcagaattcacacctaaatcgtcatcaaagtacccacagtagagacaaacattttaaatgtgaggaatgcggggaaacctgtcatatttccaacctttttagacatcagagactacataaaggggaaagaccctataagtgtgaagaatgcgagaagagcttcaaacagcgctctgacctctttaaacaccacagaatccacactggggagaagccctatggatgttccgtctgtgggaaacgcttcaatcagagtgcaaccctcattaaacaccagagaattcacactggggaaaagccttacaaatgtcttgaatgtggggaaagatttagacaaagtacacaccttatccgacaccaaagaattcatcaaaataaagtgctgtcggctgggcgtggtggctcacgcctataatcccagcactttgggaggccaaggcaggcagatcatttgagatcaggagtttgaaaccagcctggccaacatggtaaaatcctgtctctactaaaaatacaaaaatgagccgggcatggtggtgcatgcctgtaagcccagctattcgggaggctgaggtaggagaatcacttgaacccaggaggcggaagttgcagtgagctgagatcatgccactgcactccagcctgggcaacagagcgagactccatctcaaaaaagaaataaagtgctgtcattttgatatgtt

SEQ ID NO: 202342 - DNA, 2017 bp, Homo sapiens
  Payload ID: 19912
  Gene Name: zinc finger protein 394
  Uniprot ID: Q53GI3
  ENST ID: ENST00000426306
  CDS Start-End: 172-660
cgagagagttgtaggcgcaaagctgaggaaaggagagtgtggagaggggcctggtgtggtggggcccggtgtttgggaccggagggtgttgacggctgatgagttccttgggtttgctctttcttcacctgaaaagaagactccaggaagggcagcacatgccggagaaagatgaattccagcttgaccgcccagaggcgcggcagtgacgccgagttgggaccctgggtgatggctgcgaggtccaaggacgcggcgccgtcccaacgcgacggacttttgcccgtgaaagtggaggaagactcacccggaagttgggagcccaactatcccgcggcttcgccggaccccgaaacttctcgactgcactttaggcagctgcgttaccaggaggtggctggaccggaagaggcgctgagccggctccgagaactctgtcgtcggtggctgagacccgagctgctctccaaggagcagatcctggagctgctggtgctggagcagttcctcaccatcctgcccgaggagcttcaagcctgggtgcgagagcactgcccagagagcggggaggaggcggtggccgtggtgcgggctctgcagcgagcgctcgatggaacctcatcccaggtttggaaagcagagtggagaacaaagagttgattccaatgcaacaaattttagaagaagcggagccacaggggcaactacaagaagcgttccaggggaagcgccccctgttttctaagtgtggcagtacccatgaggacagggtggaaaagcagtccggagaccccttgcccctgaaacttgaaaattctcctgaagcagaaggactcaacagcatctcagatgtcaataagaatggttccatagaaggggaagactctaaaaataatgaattgcagaacagtgccaggtgttccaaccttgttctatgtcagcacatcccgaaagcagagaggcccactgacagtgaggaacacgggaacaagtgcaagcaaagtttccacatggtgacgtggcacgtgctgaaacctcacaagtctgacagtggagacagtttccatcattccagcctttttgagacccagaggcagctccatgaagaaagaccttataaatgtggtaactgtgggaagagtttcaaacaacgctctgacctctttagacaccagagaatccacacaggtgagaaaccctatggctgccaagaatgtgggaaaagcttcagccagagtgctgccctgaccaagcaccagaggacacacacaggcgagaagccgtacacctgtctgaaatgtggggagcgcttcaggcagaattcacacctaaatcgtcatcaaagtacccacagtagagacaaacattttaaatgtgaggaatgcggggaaacctgtcatatttccaacctttttagacatcagagactacataaaggggaaagaccctataagtgtgaagaatgcgagaagagcttcaaacagcgctctgacctctttaaacaccacagaatccacactggggagaagccctatggatgttccgtctgtgggaaacgcttcaatcagagtgcaaccctcattaaacaccagagaattcacactggggaaaagccttacaaatgtcttgaatgtggggaaagatttagacaaagtacacaccttatccgacaccaaagaattcatcaaaataaagtgctgtcggctgggcgtggtggctcacgcctataatcccagcactttgggaggccaaggcaggcagatcatttgagatcaggagtttgaaaccagcctggccaacatggtaaaatcctgtctctactaaaaatacaaaaatgagccgggcatggtggtgcatgcctgtaagcccagctattcgggaggctgaggtaggagaatcacttgaacccaggaggcggaagttgcagtgagctgagatcatgccactgcactccagcctgggcaacagagcgagactccatctcaaaaaagaaataaagtgctgtcattttgatatg

SEQ ID NO: 202343 - DNA, 4808 bp, Homo sapiens
  Payload ID: 19913
  Gene Name: zinc finger protein 395
  Uniprot ID: Q9H8N7
  ENST ID: ENST00000344423
  CDS Start-End: 133-1674
aggttcaagtgcgcatgtgcgcgaggagtcgctcgggcacttattgagcgccgactgtctacgggcggccgggggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaaaaaaaagagtttctggctgatgggtgactcagagtgcaggactgcctggccgtggggcagaggggtttgcccttctcggagggtacctcctgttccctgtctgagcatcctgcatggaagtcaaaggaaatccctttcttggtgacgacttaaatctgggttccctcagacattgggttgcaccccaacaaatattaaatggcttcttcttaaagcccagagaaagaggttttttaaaagactgtcgccaaatagctgagccaaaaggctgatcagaattcactttttggaatgtggcagttaaacactaccttgatcattctctcctctttcctcgaggaactcctggagggtttgagcgtctggaaactctctgctctgacccgaggaagcaccctcctgacgccgccttcctccggttattgaaaggacgcctcagaaatgctttgttttcttttacgatgtattcagaagcctttactgattaaagttttcttttatttgggtggccgggagagacccagggaggttctggaggttcctttctgtctcctggccccaccagggatttccccatttctgtttgctgcctgaaagcaggatgaggaaggccaaggagagtccttgcacccgtgagcgtcaggatgaggaaatgacaggaggaagacgtgggtttgggttagtggctgctggcgttttggcccttggtgtttctggagcctccagggatctaggggagcctgggctgcgtgcatgtcgataagcagagctgttcttggggagaaggagggaggtctcgggagtgtagcaccatgccaaccagccctgcgcgaagacagagtgagccacgcccggatggcagggcatgtttctgttttggtgtctcactttcctcccagcgtgacttatttggggattcctcagggcctactggaatgtgactgcccactgcccagctgcctcgggtacaagtcctggccctatgtcccagctgtcaggggctcagggaatcctacccagccacctgtcctgggatggagtgtcagcatccaccccttggttgtcatcgaggccgccctcccagtcctgggtgaagatatttgggccaccagggctcccttggccccttcacgtaggaaatagacacgtgctttttaatgcaggacactttgagtgttacaaaatctgtagacctggcagtagggtcatgatgttgggaagggtgtagtgccctaggttggtgacagaagggacagacacttgtgcacaggtgtctttggtgatggggtttttttttttataacttagtaaaaaaaaaaaaatgtatgtggaattctgtctcttggtaaagctcaaagccaggctagcctgaggtggcgcagggctctccttcctgtcccttcgatctccttgagaattaagagctggcagctgctgatggtgtttcccaacccccctcacttcccaagacaacccccagcttcaggtcctcatggggaggggagggcacgttcttgacacatgggaacttcgctcaggagggcctccccttcccctctccctcagagttttcactgccgtctcgtctttagaaagctgtttgaattccccccgcccccagtttggaccgtgtagatataactggatatacggatttttctctttgtgcaggcttcttatgccgttggtatacagggcaggaaagagaggaataaagggagagagcagtgtggaaaccacggtggttttgctttgttcttactaggttttggtgccaccttccctgcctgcgcttgtgccccctctcctccttggcactggcggcctccttgcctcccttccacccgtgctgccatcccgtgcctgtcgtgttggttcttcacacgtgctctgttctcggggttgttccattcatgccttcttggagggtgagggtggcttgggaaccgacccagtgatcatgcctactttcttctttgtatctccctccttcccagcccacccgggcagcagactctgatggaaggaaggtgccgtaggtgggcttttagaaactaacgggactggttttcaaagcagttatcttgggaaactgtttattccagcgatgtgacttttttcagaatatttcttggaatcatattcagagtctggggctgtgtgttgagcagccttaaggatgctagacactcatttagtgcccagggagtccagcgaatgacgtctgtggccaagcgaggtctcaggtgcaaagcaaaaggaccatttaaagtaaaatagcttggattcaatcatgtgacttttaaattggctcagaaagcaattttgtaatttcagagagtgttttgagccatggccacgttgtcattgtgagtctatagcttgactccttggagaacaatattcatttggttgtggagactgatttgctgggagaaatctgtcctgttactttctggtcatcccaggttctgacttttaccaggggcaaaaaaaaaaaaagcaagagggagataaatcccatctgtgagtttgtcttattggcgcctttttcctcagctgtcttccaagtattatttttactgttaaaaaattttttaaaaatgtgaaatgtaatgtttttacagcaacaatatgaaatatattttataaggaataaaatggtaccttgtctgatttaa

SEQ ID NO: 202344 - DNA, 625 bp, Homo sapiens
  Payload ID: 19913
  Gene Name: zinc finger protein 395
  ENST ID: ENST00000520535
  CDS Start-End: 1-93
ctgccctcaggggctctcagcaagtcagctcctgggtccttctggcacattcaggcagatcatgcataccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaa

SEQ ID NO: 202345 - DNA, 584 bp, Homo sapiens
  Payload ID: 19913
  Gene Name: zinc finger protein 395
  ENST ID: ENST00000521185
  CDS Start-End: 212-584
acttattgagcgccgactgtctacgggcggccgggggcctgagccgcgccttgctgctgggtctccacttgtggggaagagagaactggaccaggacagcgcgggaaactgacaatgccactgcttgctagctttgggattttggacaaataggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctgg

SEQ ID NO: 202346 - DNA, 699 bp, Homo sapiens
  Payload ID: 19913
  Gene Name: zinc finger protein 395
  ENST ID: ENST00000521912
  CDS Start-End: 137-699
gtcttgcactgtttcctaggctggagtgcagtggcacaatcacagctcactgcagccttgacttccccaggctcaagccattctcctacctcagcctcccaagcagttgggaccacaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgg

SEQ ID NO: 202347 - DNA, 1790 bp, Homo sapiens
  Payload ID: 19913
  Gene Name: zinc finger protein 395
  Uniprot ID: Q9H8N7
  ENST ID: ENST00000523095
  CDS Start-End: 89-1630
gctagccgtccgagccgagccgtccgagccggggaagccgggcgcgtgctgccgctcgtggcgggccgaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctccca

SEQ ID NO: 202348 - DNA, 2068 bp, Homo sapiens
  Payload ID: 19913
  Gene Name: zinc finger protein 395
  Uniprot ID: Q9H8N7
  ENST ID: ENST00000523202
  CDS Start-End: 337-1878
ctgcacagggagtttgtcttgtgcaaacaatttccaaggcagcgttttcttccctgcctgggagtgcagggctcagcgccttcactttggaactgactcagagacctaaagaagcccacctggccagcgggaaggggggccgccgccgcctcccggttttgggcagccctggccagctccctgtggccttggaggacttccaccgggcaggcgttcccatgatgccaggctaccaggcgcgggggattcctgcaggccggcgctgcttttcttagaaccccctttctagaaaagtacacctgggggttttgcttcaaagagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaa

SEQ ID NO: 202349 - DNA, 224 bp, Homo sapiens
  Payload ID: 19913
  Gene Name: zinc finger protein 395
  ENST ID: ENST00000517459
  CDS Start-End: 83-224
tcgggttctgtggacacaggcaggaagcttaagaggctctgctgagcagggacctggggaagaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcacca

SEQ ID NO: 202350 - DNA, 501 bp, Homo sapiens
  Payload ID: 19913
  Gene Name: zinc finger protein 395
  ENST ID: ENST00000522795
  CDS Start-End: 194-501
ggagccgggccgcgggccgcgccgggagggcgggcagggccgcggccgctgcagcccggagctgagctagccgtccgagccgagccgtccgagccggggaagccgggcgcgtgctgccgctcgtggcgggccgaggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtca

SEQ ID NO: 202351 - DNA, 703 bp, Homo sapiens
  Payload ID: 19913
  Gene Name: zinc finger protein 395
  ENST ID: ENST00000520290
  CDS Start-End: 234-703
gcgaggagtcgctcgggcacttattgagcgccgactgtctacgggcggccggggacagtcttgcactgtttcctaggctggagtgcagtggcacaatcacagctcactgcagccttgacttccccaggctcaagccattctcctacctcagcctcccaagcagttgggaccacaggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaa

SEQ ID NO: 202352 - DNA, 2788 bp, Homo sapiens
  Payload ID: 19914
  Gene Name: zinc finger protein 396
  Uniprot ID: Q96N95
  ENST ID: ENST00000306346
  CDS Start-End: 133-1134
agaaccggaagttgttgcgcagctggcagttccccggtttctccccgacggcgtcgggaggagtgtccatcaggacagcttcacctccttgaggattaaagcctaacagtactgagctatttgtctgtcaaaatgtctgcaaaattgggaaagtcatcatcactcctaacacaaacttcagaggagtgtaatgggattctgacagagaagatggaagaggaagagcagacctgtgatccagactctagcctccactggagcagcagctacagcccagagaccttccgccagcaattcaggcagtttggctaccaggattcacctgggccccatgaggctctgagccggctctgggaactttgtcatctctggctgaggccggaagtgcacaccaaggagcagatcctggagctgctggtgctggagcagttcctggccatcctcccaaaagagcttcaggcctgggtgcagaagcatcatccagagaatggagaggaaactgtgactatgctggaggatgtggagagagagcttgatggaccaaagcagatcttttttggacgaaggaaggacatgattgcagagaagctagcaccttcagaaatcactgaggaattgccaagtagccagctcatgcccgtgaagaagcagctccagggagcatcatgggagcttcagtccttaagaccacatgatgaagacatcaaaactacaaatgtgaaatctgcttcaaggcaaaagacttctttaggcatagaactgcattgcaatgtttccaatatccttcatatgaatggctcccagagttccacatatagaggaacctatgaacaagatggtaggtttgaaaagagacaaggaaacccttcttggaaaaaacaacagaaatgtgatgaatgtggcaaaatctttagtcagagctcagcccttattttacatcagagaatccacagtggaaagaaaccttatgcatgtgacgagtgtgcaaaggcattcagccgaagcgcaattctgattcagcatcgacgaacccatactgattcaaaatatgaacatgcgattgcagaggcccaaaagaatatgtacttcaagactaggctgaagtgccccaggtcactttcaggaggcagataaataaaggccttatcttatgaaagcacacaagagcctccatactattaatatcaagttaatttcccgtgttggaaaaaaataatctcctttgcaatgtaatttggaaataagtcaatggaaacatgaaaatgactgcttgtctacaaggagtcagctaaacataaggaatgttttcataacaatattaatctatgggtgcttctgtaagatggatgatcatcttaatataaagaaaaaagggagatgaacaaaattgtcaaacaagactgatgtaccacaagtgttgtcaagtacagtgtgtgtcggagagatgtaccacagcttaactggaagaggaagcccgtaactgctgatgacaatactttcagtgtccccttttctggcataaatcaactatgaatatgtttcaagcatcacaagacaaccttttcagagtcttctgtattcttagtaagatgagtttctagacacgctgtcatgaaatgagaccctggattttgatgctcttgtacatatggacaaatcactgaagttcaatttaaagggtccactgcagtcccttataaacaattgttgaacctaaccattatagtttataagttttaagacatttatgggatatcttatttggcttatctatgggatatgagtaactatgttttacctgcatttaattcagccagattccctgtttaaaattactgaatcgtacattattaaaattattctgacagtatacaaacaacaaaattatctattttccagagattcttgataaaactctgtaatgttactacaataatacatgtattgtgttttccatggtgctacagttacacaatatggaggcaaacatcagaaatcaaagtccttggaataagggaagagactcatagtaaacttctttgtctggttgggttcctcataaagtataaaacatttcattctcagaaaatccaaccatatcttagagtatctccagaaactggcttagaggagctccaaatatgtggaattaccacactctgcttagttagtatgctgataaatgtaagattagtaggaggagaagtgaatgtaaattttattatagaattttctgatagtgattatgatttgtagctctagtgaatatgaattttatattgagttgtgtgtatcttgagtcactaaaaatgtaggatactttttatttggggctcattgtctttgtaattacggagaggaacaaaccatctattgaaacaacaagtgcctcagagatgtatatattgtgaattactgcttaattacggaaagagtttcttaggttctatgtgaataagatggcagaatctaaatcaagtattttgaaggaagcacccatcttcacttggtgctgccatcaactttgtaagattgcattctatttattgtgaataatttgagtgtttccacaggaaagtggtatgaatcatatcgtctaagtatatgatgaatctttaaagggtgtctctgtgtactttgaattattttgcagttatgtaggtatcctaatgagtgaatggtactagtttatataaaaggagaattcattgagctaaccttggttttaaaaattagcattagcacccccattatattaattttcagggatagtaaatactccaaaatg

SEQ ID NO: 202353 - DNA, 578 bp, Homo sapiens
  Payload ID: 19914
  Gene Name: zinc finger protein 396
  ENST ID: ENST00000587422
  CDS Start-End: 460-578
agttccccggtttctccccgacggcgtcgggagaagtattcttcaaaagcatggtttctgggcctggcgtggtggctcaagcctgtaatcccagcacctcaggaggccaaggcgggtggatcacctgaggtcaggagttcgagactagcctggccaacgtggtgaaaccctgtctctactgaaaatacaaaaattagccaggcgtggtggcgggtacctgtagtcccagctacttaggacgctgaagcatgagaatcacttgaacccaggaggcagaggttgcagtgagccgagatcacaccattgcactccagcctgggcaacagagcaagactccatctcaaaaataaataaataaataaaagcatggtttctgttaagactaaggagtgtccatcaggacagcttcacctccttgaggattaaagcctaacagtactgagctatttgtctgtcaaaatgtctgcaaaattgggaaagtcatcatcactcctaacacaaacttcagaggagtgtaatgggattctgacagagaagatggaagaggaagagcagacctgtgatccagactctagcct

SEQ ID NO: 202354 - DNA, 1884 bp, Homo sapiens
  Payload ID: 19914
  Gene Name: zinc finger protein 396
  Uniprot ID: Q96N95
  ENST ID: ENST00000589332
  CDS Start-End: 133-1140
agaaccggaagttgttgcgcagctggcagttccccggtttctccccgacggcgtcgggaggagtgtccatcaggacagcttcacctccttgaggattaaagcctaacagtactgagctatttgtctgtcaaaatgtctgcaaaattgggaaagtcatcatcactcctaacacaaacttcagaggagtgtaatgggattctgacagagaagatggaagaggaagagcagacctgtgatccagactctagcctccactggagcagcagctacagcccagagaccttccgccagcaattcaggcagtttggctaccaggattcacctgggccccatgaggctctgagccggctctgggaactttgtcatctctggctgaggccggaagtgcacaccaaggagcagatcctggagctgctggtgctggagcagttcctggccatcctcccaaaagagcttcaggcctgggtgcagaagcatcatccagagaatggagaggaaactgtgactatgctggaggatgtggagagagagcttgatggaccaaagcagatcttttttggacgaaggaaggacatgattgcagagaagctagcaccttcagaaatcactgaggaattgccaagtagccagctcatgcccgtgaagaagcagctccagggagcatcatgggagcttcagtccttaagaccacatgatgaagacatcaaaactacaaatgtgaaatctgcttcaaggcaaaagacttctttaggcatagaactgcattgcaatgtttccaatatccttcatatgaatggctcccagagttccacatatagaggaacctatgaacaagatggtaggtttgaaaagagacaaggaaacccttcttggaaaaaacaacagaaatgtgatgaatgtggcaaaatctttagtcagagctcagcccttattttacatcagagaatccacagtggaaagaaaccttatgcatgtgacgagtgtgcaaaggcattcagccgaagcgcaattctgattcagcatcgacgaacccatactggtgagaagccctacaagtgtcatgactgtggcaaagcctttagtcagagctcaaatctttttagacataggaaaagacacattagaaaaaaagtcccataagtatcatgagggaatcaaagcatttactcagagctatttcagcacaagggaagacaccagatgcaaacgctccttagtacaaatcagtggtcttagtaagcaccagtctcctttcaagactcatgaaagccacaggagagaaggttgaagatctcaggtcagcattatttgcttttctgcttatcaatgcagtctcaattctgacgtttgcaattccaaagcttaattcagatttccatccctatgcaggccttgaaaaggcattctcagacatgttctactattttcattattaacacatataatgaattagtatatatctttttagacaagtatgttttttccctcattgagaaggaatgtgtgagttactcagtgtaaaaatagacattctcctccatttcataacttgagcactagaattctaaagaccaaaaattaaagcactcaaaaagaattcctggctgggtgcggttggctcatgcctgtaatcctagcactttgggaggccgaggcaggcagattgcctgaactcaggagttcaagaccagcctggacaacacggcgaaaccccgtctctactaaaattcaaaaaattagccaggcatggcaacgtgtacctgtaatcccagctactagggaggctgaggcaggaaaattgcttgaaccgctcagacagagcaagactccgtctttaaaataaataaataaataaataaataaataaataaaaataaaaataaa

SEQ ID NO: 202355 - DNA, 1320 bp, Homo sapiens
  Payload ID: 19914
  Gene Name: zinc finger protein 396
  Uniprot ID: Q96N95
  ENST ID: ENST00000586687
  CDS Start-End: 133-765
agaaccggaagttgttgcgcagctggcagttccccggtttctccccgacggcgtcgggaggagtgtccatcaggacagcttcacctccttgaggattaaagcctaacagtactgagctatttgtctgtcaaaatgtctgcaaaattgggaaagtcatcatcactcctaacacaaacttcagaggagtgtaatgggattctgacagagaagatggaagaggaagagcagacctgtgatccagactctagcctccactggagcagcagctacagcccagagaccttccgccagcaattcaggcagtttggctaccaggattcacctgggccccatgaggctctgagccggctctgggaactttgtcatctctggctgaggccggaagtgcacaccaaggagcagatcctggagctgctggtgctggagcagttcctggccatcctcccaaaagagcttcaggcctgggtgcagaagcatcatccagagaatggagaggaaactgtgactatgctggaggatgtggagagagagcttgatggaccaaagcagatcttttttggacgaaggaaggacatgattgcagagaagctagcaccttcagaaatcactgaggaattgccaagtagccagctcatgcccgtgaagaagcagctccagggagcatcatgggagcttcagtccttaagaccacatggtgagggggcaggattcagttcatgttggaaggtgtgggggccctctgctcaccacacacatctcagctgatttatgcaagaggcctcaaatctccccctctcatctcctccttactgtgggaacttctgttatttgtcctactaaatgaagatcttcagtattttgttcttgcttctttttcagagattcttataaaatcttcagactttaaatccctgacatctgcatcagggttttcatgcctttttaaagtagcccttttatcttcaggcagcccttgaggcctttctgtgggaccccaaggtacacagcccagagaccactgatcctcatcatcatttcctatataactgctcagttactggtgggatctcgtagcagaatcgcctatattgctgctaaggtgactttgctctcatacgtgctttgaatacacttctctactccctcacatcttcaactggcctcaactgctctttgcattgctttctataagtgctccagaatagctgtgtagcaatctattcttccattgcagatactaaacaaataagtgctatggggaaaaaataaaaacaaaacagaataagggggctagagggaaggtgagaagtagaaataagg

SEQ ID NO: 202356 - DNA, 670 bp, Homo sapiens
  Payload ID: 19914
  Gene Name: zinc finger protein 396
  ENST ID: ENST00000585522
  CDS Start-End: 277-670
agaaccggaagttgttgcgcagctggcagttccccggtttctccccgacggcgtcgggagcacatcattgtgtaaagttgtatcatttatttggtaacaactttatgaactcacaggctttatacagggcctagaacaatacttggtgaagtgagaaaataagtcaaatggcaggatacataacgatggaagacggaggcgcacgagtgtccatcaggacagcttcacctccttgaggattaaagcctaacagtactgagctatttgtctgtcaaaatgtctgcaaaattgggaaagtcatcatcactcctaacacaaacttcagaggagtgtaatgggattctgacagagaagatggaagaggaagagcagacctgtgatccagactctagcctccactggagcagcagctacagcccagagaccttccgccagcaattcaggcagtttggctaccaggattcacctgggccccatgaggctctgagccggctctgggaactttgtcatctctggctgaggccggaagtgcacaccaaggagcagatcctggagctgctggtgctggagcagttcctggccatcctcccaaaagagcttcaggcctgggtgcagaagcatcatccagagaatggagaggaaactgtgactatgctggaggatgtggaga

SEQ ID NO: 202357 - DNA, 1419 bp, Homo sapiens
  Payload ID: 19915
  Gene Name: zinc finger protein 397
  Uniprot ID: Q8NF99
  ENST ID: ENST00000261333
  CDS Start-End: 136-963
gtggcttgcagctcggggtgggtggctcatttcctggccgctcctgggcttcgcggaaagaagagattactcacactccttcgcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgattgtgagaacagtgaaacagcaacaaaagagggcatctcagaagaaaaatcacagggactccctcaggaaccttcatttcgaggaattaagttgtccagacctcccaaagcttcttcagctatccgttgggaatgtgtttctccaggaagttttcccggcgatatcatagctgctgaggctacacattcaacaatttcttgctttgccatcaacactttgccagccaccatcctgccatctaaaaatgtgaatagaaagtatttttcctgaagaacacatcgtcaataaatcacctgcacccaaatctccatctcaggcgctacttctggcaaggcatatcatgaggctagtgaagcacctacaagaaacttataactcaaggttgtaaaaatggcatggtgactcttacaatcatatcacagtgggcctctccaacaatttaaacctcatgacctaggtgaaagctgtgaaaggatccacattaattcttcagaggcagggctaagactttcaagactgaaaagagactagcataaggagacttaacaggaacccagtcaaggccattcatggccatgggaccacgcataaatggagaacgagtaaattttgctaagtccaaggacattggagagatagagtcactattactgatatggtgactgagtcaacaacatactgccactatgaagtaataagaaaataaaaagttaaaaaatgtaacag

SEQ ID NO: 202358 - DNA, 5251 bp, Homo sapiens
  Payload ID: 19915
  Gene Name: zinc finger protein 397
  Uniprot ID: Q8NF99
  ENST ID: ENST00000330501
  CDS Start-End: 154-1758
cgcgcacttccggtctttgtggcttgcagctcggggtgggtggctcatttcctggccgctcctgggcttcgcggaaagaagagattactcacactccttcgcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgattgtgagaacagtgaaacagcaacaaaagagggcatctcagaagaaaaatcacagggactccctcaggaaccttcatttcgaggaattagtgagcatgaaagcaatttagtgtggaagcaaggaagtgctacaggggagaaactaagatctccttcccaagggggcagttttagtcaagtgatcttcacaaacaaatctctaggaaagagagacctttatgatgaggctgaaagatgcttgattctaactacagactctataatgtgtcagaaagttcctccagaagagagaccttatagatgtgatgtatgtgggcacagcttcaagcagcattcctctctaacacaacatcagagaatccatactggagaaaagccctataaatgtaaccagtgtgggaaggcctttagtttgaggtcctatcttattattcatcagagaattcatagtggtgagaaagcatatgaatgtagtgaatgtgggaaagctttcaatcagagctcagccctcattagacatcggaaaatccatactggtgagaaagcttgtaaatgtaatgagtgtggcaaagcattcagtcaaagttcatatctcattatacatcaaagaattcacactggtgagaaaccttatgagtgtaatgaatgtgggaaaacctttagccagagctcaaaactcattagacatcagcgaattcacacaggagagagaccctatgaatgtaatgaatgtggaaaagctttcaggcagagctcagagctgattactcatcagagaatacatagtggagagaaaccctatgaatgtagtgaatgtggaaaagctttcagtttgagctcaaaccttatcagacatcagagaattcatagtggggaggaaccttatcagtgtaatgaatgtggcaaaactttcaaaaggagctcagcccttgttcagcatcagagaattcattctggggatgaagcttatatatgtaatgaatgtgggaaggctttcaggcacagatcggtccttatgcgccatcaaagagtccacactataaagtaatttgtgaatactgtgaatagtgtaaatacttcagtcagatttttaagtttgttagtcaaaagagtttactttggagcaaaactccataaaggttataaaatactaggtcttgagtctagcttgctttgtgcagcatttcccagtgctaatgtaaagtgtcccttgaaagcttttcctgtgactaatcagaacagaatacagaagaatcattacttccagctcttctcttattaggaatactcaggaaatacgaaaagtgggaatgtaacattgaaacctcattttgtatgaaagtgtcatgaatatagcaacccaggctctgtcactgcatctgattgttagtgtgccaggttatggggctggtgtggactgtgtgaggcacttcgtctcaggaactaaaaaaaaaaaaaaaactgacccaataaagaacagtgacagagcagcaggaaaggtggggaaatggcttcatcaatgatttgttgagcccagggcaggccaggaattagataggcatgagaagaaagaatataatttacccaaaggttattttttgagtacctactttgtcccaggaactaggaatacagtggaaaacaagactgtagtctctacagtctaatgggcaaggcagccagacaggcagtgaaagtggaatgctcctatgtgaccttaaggagcacctgactcagccttggataaggaaatgggggaaatggcctgaaggatgaggaggagttagccaaggtggtactctagggaagtggtaccccagtaaagaacagtagccaaaggccagaaacaaagtgtggagcattccttgagttcctgttgtagtgaggtcttgtctgtcagagaagtctgggtctggccagactcttaagcagtgccaatggagaagttcctgttaatagacaaaacctggagcccttgggccacagggtagtcaagagctttgtcttggtttatgtgaccccagggaaagggcaaatatgtggtttccttgcccaacctgtaggctatcctagaacttccatgagggtggtggtgggaatgagggtgagaaagagcccagcctatacctcaagagtctgctagagtgttaagactctattctcctttgattctaaagacaatatcagagctgctgtcaggtttcttaaaattcccaacgctctggatcagaagctgccatatcatttgtttctggggctatacgcccacaattcctagtacattcccttgggctttggtgctcaaaaaatatttgtcagttgctgggtctgtgacattctttgggcacctcgcacatgttcagttttgtcttatgtcaccagtatttcacaatatcttttgcaatttttttttttttttttttttttttgagatggagttcgctcttgtccaggctggagtgcaatggcacgatcttggctcaccgcaaactctgcctcctgggttcaagcgattctcctgcctcagccttctgagtagctgggattacaggcatgcaccaccacagctggctaattttgtatttttaggaaagacagggtttctccatgttggtcaggctggtctcgaattctcgatctcaggtgatccgcccgcctcggccccccaaagtgctgggattacaggcgtgagccatggcgcccaaccatcttttgcaaattttattaaagacaatgctaaaaggaagtgacaactgaaactaatggtcacagtcagtcaagacttcccttttctgaggggcctagcaggaagagaatatttagactgatgcttagtgtaagaaggaatgttgtacaggttaaccagcaacacaaagacatattcaaaagacctaataggtcagaagaataacataccacaccaaaaacaaatctgtatggaaatctagaatcatgtgcatagaaaaagaattttcatgaggataaaaagaagcaaagagaagtaatgctcttattggggcgtgcatcagtggacatgtgctaaccagtaagaacagcaggaggcctaaatgcccatgtttagggagagaatatggaaaaaatggatgggattatttggaaaagatgtaagagattaaaatacgtggtaagagctactcaactcttgtttttctccttttccatagataaagacctgaacaaactgaaaaggtaggacgtaaagtaggaattgtaaaacggaaatactctttatataagaaagctctactgtatgtcagaaagcaatgtaatagatagaccaagcacagtggctcacacctataatgccagcactttgggaggccaaggctggaggattgcttgagtctaggagttcaagccgagcctgggcagcatagtgagaccccatctctacaaaaaataaacagaatttgccagacgtggtagtgcatgcctgtagacccaagtatttgggaggctgaggtgagaggttcgcttgagccctggaagtcgaggcttcagtgaggcaagatcacaccactgcactccagcctgggagagcaagaccctgtctccaaaccaaaaaaaaaggaaaaaagtaaatgtaatagatacttgctaagggctttgtatatacttattattgttatttctcagcacgtatgtagcagatgaggaaatgaaggctaaaggtcatatatctacaaagtggggaggtcagactttgaacccacaacctgactgtggagccacttcagtatactctctccccataagaaagttccaatagaaaaaaaatgctacttaagtagggaaatcacaaaataagtgccaatgaacaataaatgttcaacctcactacagttaaaatgtatattaaagcaagagttgagatgacacttttccttataaaacagacagggattcagggacattgggactctaatgctgctggtaagacatgaataaatacataccatctctggcaatcaataccagaagctttaagcattgccttttgactttgaaattgtacctggaaatgtatgtttcagtaaccatcatgaatgtacacaaaatcctgaaactcttaaaactgatgtcacaggccaggcacagtggctcatgcctgtaatcccagcactttgggaggctgaggcgggtggatcacctgagatcaggagttcgagaccagcctgaccaatatggtgaaaccccgtctctactaaaaatacaaaacaattagctggtgtggtggcatgtgcctgtagtcccagctacttgggaggctgagacaggagaattgcatgaacccgggaggtggaggttgcagtgagccgagattgtaccactgtattccagcctgggtgacagagtgagactgtgtctcaaaaaaaaaaaaaaaaaaaaaaaaaacactgatgtcaattaatattaaatgaagtattcatgatatattgttaagtaaaaatattacaaaacaatatgtacagtatgatcctatgtaaaatatatatttatgtattaaaaatactgaaaac

SEQ ID NO: 202359 - DNA, 2162 bp, Homo sapiens
  Payload ID: 19915
  Gene Name: zinc finger protein 397
  ENST ID: ENST00000355632
  CDS Start-End: 136-873
gtggcttgcagctcggggtgggtggctcatttcctggccgctcctgggcttcgcggaaagaagagattactcacactccttcgcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgagttgtccagacctcccaaagcttcttcagctatccgttgggaatgtgtttctccaggaagttttcccggcgatatcatagctgctgaggctacacattcaacaatttcttgctttgccatcaacactttgccagccaccatcctgccatctaaaaatgtgaatagaaagtatttttcctgaagaacacatcgtcaataaatcacctgcacccaaatctccatctcaggcgctacttctggcaaggcatatcatgaggctagtgaagcacctacaagaaacttataactcaaggttgtaaaaatggcatggtgactcttacaatcatatcacagtgggcctctccaacaatttaaacctcatgacctaggtgaaagctgtgaaaggatccacattaattcttcagaggcagggctaagactttcaagactgaaaagagactagcataaggagacttaacaggaacccagtcaaggccattcatggccatgggaccacgcataaatggagaacgagtaaattttgctaagtccaaggacattggagagatagagtcactattactgatatggtgactgagtcaacaacatactgccactatgaagtaataagaaaataaaaagttaaaaaatgtaacagataacagttggagggtgaatatattttaaatcaatcagattctcattagagtattttattttgtcttgatccccaaacttcagatgaatgtggagaaactgaagcatgtccagagaaaagtggcaagatatccaaacagacagaacacagatgggatcagagggagtgagaggcttagttaaaacaaggtcaggaggctgggcacggtggctcatgcctgtaattccagcactttgggaggccgaggcgggtggataacaaggtcaggagtttgagaacagcctggccaatatggtgaaaccccatctctactaaaaatacaaaaattagccaggcgtggtggcgggtgcctgtagtcccagctactcgggaggctgaggcaggagaatcacttgaacccaggagttggaggttgtagtgagccaagatcacaccactgcactctagcttgggcgacagagccagactccatctcaaaaaaaaaaaaaaaaaaaaaaaaaaaaaaaaggtcaaagtgcagtgtactcactgcattcaagtatagattgtgttttatgaggactctgtaaactaaagaaagtggattatgaataaattaaagttgggagtatttcatatggacataaggaagaattttaatatagtatgtttactagggtttccacaacaaaataccacagaatgggtggtaaacaacagaaatctcttttctcacaattctagagactagaagtccaagatcaatgtgtcagcaggtttggtttcttctctctccttggcttgcagatgatggccaccttcttttcttgttgttgttgagatagtctcactct

SEQ ID NO: 202360 - DNA, 602 bp, Homo sapiens
  Payload ID: 19915
  Gene Name: zinc finger protein 397
  ENST ID: ENST00000588119
  CDS Start-End: 1-602
ggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtgggaacggagaaaagtgatgtgggaaaaggaatttacagcctggagcatgtaatggtcccagctagtccacagggaccagcagtgccatggaaggatttaacatgtctcagagcatcccaagagtcaacagacatccacctccagcccttaaagacacagctgaaatcctggaaaccatgcctttccc

SEQ ID NO: 202361 - DNA, 1516 bp, Homo sapiens
  Payload ID: 19915
  Gene Name: zinc finger protein 397
  Uniprot ID: Q8NF99
  ENST ID: ENST00000591206
  CDS Start-End: 154-777
cgcgcacttccggtctttgtggcttgcagctcggggtgggtggctcatttcctggccgctcctgggcttcgcggaaagaagagattactcacactccttcgcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtggtgaggaatgggaaatcatctggaaactcttgacacttaggcctctgtttttgagaatgcagaattaattgcacttgacaaacttgccacatgtgagcatcacctttattattctaaaccagaggtgctcgctttagcggctttgtattcacccctcatgaattgctgtcagccctcctgtgtgagtttccctgttattcattcattcatttcattatgttgtaactttataaagcgtcaatacatgtctggtactgtggtaggccccaggagaggtttcaggtctaggtgggtgatggacaaataaaaaggcagttgcaatgtagtaaattatagaatataagtaggcagtgggtactgttggagcacatctaaaggcacctaacccaatcttagaggatcaaggaacacttcctgaaggaagaaaatctaagctaagacttgaactatgagtaagagaaagccaggtaaataggtgggaggaggagtagcccaagtaaaggccataccatcccgaaggtgtgagaatataacccattctgaaaattgcaggtagtttaatttgacttgaatggagaattgacaggtggtaagagaagaaccagagaggaaaataggatccaagtcatgaagacctgtatgtcatgttaatttgtttgtatagtttcttaagtgcagtgggatgcagttgaaggattttggacaaggagtgacatagtttgatttgcagtttagaagttagctgcaaatggagaatcatgtaaggaaggcaagagtatagtcctattaaagactgctgtaatccaa

SEQ ID NO: 202362 - DNA, 2046 bp, Homo sapiens
  Payload ID: 19915
  Gene Name: zinc finger protein 397
  Uniprot ID: Q8NF99
  ENST ID: ENST00000585800
  CDS Start-End: 715-1338
ggcttgcagctcggggtgggtggctcatttcctggccgctcctgggcttcgcggtgagggacgtgggcccctaggaagagggaggtggggttgggagcgcgcgccggacagtggaggagctccgctcctcggcctgcccatccccaggtcgcggccctttggcccgcgcggcgtctccaagcgactggggaactcagaggaggccagcactcaaactcctgctttccaaaggaaaacgcagttccgctgaccccgtgacttcgtaaatgctgcggtttaaccaaggatataaaaatagaagggctagttagttagttagttagtgcggccggactggttaaaccttaaatttgtaggctaaatattttaattcatctcttaacgttaaccgtagtgtgaggaatgaattttactcatctgtcctgacaaactaagggcatacattcctatcgatatctcgccatcctaaaagcaggtcaagtttggtctgtgtcacaacatttaatacctatttgttaccatattttgcttttgaacatttttagtcttgggatattctaagctttttcagaactgatacggatctctttgctgcttttgtgtatgtgatacctatcatgtttttgaacacatggaaagaagagattactcacactccttcgcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtggtgaggaatgggaaatcatctggaaactcttgacacttaggcctctgtttttgagaatgcagaattaattgcacttgacaaacttgccacatgtgagcatcacctttattattctaaaccagaggtgctcgctttagcggctttgtattcacccctcatgaattgctgtcagccctcctgtgtgagtttccctgttattcattcattcatttcattatgttgtaactttataaagcgtcaatacatgtctggtactgtggtaggccccaggagaggtttcaggtctaggtgggtgatggacaaataaaaaggcagttgcaatgtagtaaattatagaatataagtaggcagtgggtactgttggagcacatctaaaggcacctaacccaatcttagaggatcaaggaacacttcctgaaggaagaaaatctaagctaagacttgaactatgagtaagagaaagccaggtaaataggtgggaggaggagtagcccaagtaaaggccataccatcccgaaggtgtgagaatataacccattctgaaaattgcaggtagtttaatttgacttgaatggagaattgacaggtggtaagagaagaaccagagaggaaaataggatccaagtcatgaagacctgtatgtcatgttaatttgtttgtatagtttcttaagtgcagtgggatgcagttgaaggattttggacaaggagtgacatagtttgatttgcagtttagaagttagctgcaaatggagaatcatgtaaggaaggcaagag

SEQ ID NO: 202363 - DNA, 1104 bp, Homo sapiens
  Payload ID: 19915
  Gene Name: zinc finger protein 397
  ENST ID: ENST00000592264
  CDS Start-End: 82-648
ggaaagaagagattactcacactccttcgcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgatttttcctgaagaacacatcgtcaataaatcacctgcacccaaatctccatctcaggcgctacttctggcaaggcatatcatgaggctagtgaagcacctacaagaaacttataactcaaggttgtaaaaatggcatggtgactcttacaatcatatcacagtgggcctctccaacaatttaaacctcatgacctaggtgaaagctgtgaaaggatccacattaattcttcagaggcagggctaagactttcaagactgaaaagagactagcataaggagacttaacaggaacccagtcaaggccattcatggccatgggaccacgcataaatggagaacgagtaaattttgctaagtccaaggacattggagagatagagtcactattactgatatggtgactgagtcaacaacatactgccactatgaagtaataagaaaataaaaagttaaaaaatgtaacag

SEQ ID NO: 202364 - DNA, 532 bp, Homo sapiens
  Payload ID: 19915
  Gene Name: zinc finger protein 397
  ENST ID: ENST00000601719
  CDS Start-End: 117-532
acgcgcacttccggtctttgtggcttgcagctcggggaaagaagagattactcacactccttcgcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggt

SEQ ID NO: 202365 - DNA, 5268 bp, Homo sapiens
  Payload ID: 19916
  Gene Name: zinc finger protein 398
  Uniprot ID: Q8TD17
  ENST ID: ENST00000426851
  CDS Start-End: 852-2267
tcggtcctcagaggaggggcccgggcaccctccgtgcgggccgcagcacgccggtctttgagggacccttggactcccggatctgcatgcgagggatgcggtcgaagacgagatgagggagctgacgggaggggaaacggaggggcaggtgaacatggagagagcaggaacagggagagagtagggacagcgactgggagacgcgctccacagaaacccggactgagaggcagcgagaggacgtagtcttgctctgttgcctaggctggagtagagtggtgtgatcttggctcactgcaacctccgcctcccaggttcaagcgattctcctgcctcagcctcccaagtagttgggattacagacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctggaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaaggtgcctgtggcatttgatgatgtctccatctacttttccactccagagtgggaaaaattagaagaatggcaaaaggaactttacaagaatatcatgaagggcaactacgagtctctcatctccatggattatgctataaatcaacctgatgtcttatctcagattcaaccagaaggggaacataatacagaggaccaggcagggccagaggaaagtgagattcccacagaccccagtgaagagcctggtatttcaacatcagatattctgtcttggattaaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaacacccacagtaattattatctggcacatcaatgaatttggggtcctatacacttgactagagacatgcttgtgttttggaatttcacacccttacaagaataccacattttgaaacccagaaagacctggaaaggagcccagcatgtccatcttttcaaagatacaacaaaagcagaagttacaagaatattgcggagaggttggaaagcaggatttaacctctagttctcttgttctcagagaacagcaggttgatagtagattatgtctctaggtagagacagatacatgagaagagcctccaaaactggaagcccatcataaggcatgagaatgtttaactataaagccttttattagttctttgatagctaagatggttgttggagaaagtgcttaagccactgtttatgttgctgcctcctctctcaaaaccagccaagatctgttcacacacctctgtggctgtctttccctgaaacatggtaactcaagactgcctgcctaggtttcttagattaattattcacataaattttgtttaatattggttgaacaagaaatctgactttaaaagattattaaggagaatattccttaactatactggcttgatttgaaacaggctcttattgccatttaaactgccagaaatctttgccaaggtcctggttaaaaaaattggaaacggttttcttagccccagctttaaaagctagagatctcagagaaatagctggcttaacaatgacagaacagcttaaaatttgtgcctacaccatgttctgagagtcgttcacatcaaattcttatcttttccaagccagtaagttggcttctccattcctggtgtctgatattcttgacaatcatcagcaacaaagatcacagcactttccagaagcatggagcttcagaaagtgccagtgaactcttggtcctcagtagtgagatgataacagtgttataatgcagcttccttgagccatcagagagagtgtatgttcaccctatctggctgtatcccattggcagtggacagattgaggaaattcctagatcactgagagctaagcaccatgcatagacaacagtttgttcttgcctgtgttgcttttagggactttgactaccacatgttcttttcttggggtgatttaatcacctgggagcatctgagtctgctcctaagtggctttgcaactgggcctaagttctgtttcctttatggatctcaaattttcatctgcacaatgaggctgttgaaaggaaaaaaagtgagcctctaggaattattcaaaaaaagtctgtgatacattccttttcctgccaaagttctgtctctgtctttggcttctgtccaggcaaagctaaataagacagcaaagtcaaagcagataaattcttgttgaaacttgactaaaatttatttgatttgttgttttactcccacttggaatcctgaggtagaagacagaatgcagaagtcttacatcttgggcaggaaactggtttattcctatactcttgtttcctctgcttcttcctgaggtctagaacaaggtctggaaatgtttagacaggatattttcttgatgaagtgataaggaaaggacccatttttttgctcatcacctagcccatccttcactctctctagttatgcataacaacactagaagaaggtgttagcccagctaactttgcttctgggaaggctatgtctgaacatgttgctctgtaggataatcacacttagaaaacatctgctccatgacattcacaataccagggaccatgggagacacaagaaatgtgtgtctgctgtcataacttacagtgaaaaagcccaataatacagaacaagacatgatgggcaataccctagcatattgggattaagagctttctagccagaatctggacctataccatgggaaaatttaggggtgctgggaatcccaaagccaaggttctggcttcattggcaacccactaggaacttgaatgtgagattcagctctagtttgcaccttgatttccccagtgaaaagggagaagagccaaagtattgtctaggtgctgagttcccttttctgagtggatttcaagcatttgccagggtatgctggaggagggactcctaaagtaggtgagatgtgggactaggtaacactttaaatacttttttactcaaagatttgccaagaacacagcttattagtgaaagagacctgtggattgaaatggctgcagatagatcccgcagtcccttctgaaaggaactgtgtagccagcagggacctaaactttggcaaaaagtgaacacaattcaaatacgaatgaaggaagagccctcagatggaacgaaaggcgatgtgcaaggccatcccagagagacggaagcaggtgcgatactaagcctcagcccaagaataaaagagagttcaactgttactcttttctttcatcaatcccctatcagttagaactgcaggccagttccaaagagtgtttgcttaagattcaaaagtgggtaagtaaaatggatcagtgggaaggataaggtgtccaacagaaagtgtggaggagaaactcttggcctatcaagtgctcctgagagaaaccatgcaatttaacacttcagttaaagaaatacatgagaactgcttgtcatgaccagacaagataggaaaggggaaaccccagaaacgtgctcttcatctgtcagccttttggaccaagaagctgtcactatcacacataagcaccattcccttagagtggatccaggtgttgactataaccagatttactctttgcttactaggttttccattgtcaccattggatgaacctctggtttagccacagttgtgaaaataaatggaagttggttgattgtctagaaagtgcaa

SEQ ID NO: 202366 - DNA, 2121 bp, Homo sapiens
  Payload ID: 19916
  Gene Name: zinc finger protein 398
  Uniprot ID: Q8TD17
  ENST ID: ENST00000483892
  CDS Start-End: 624-2039
ggccgcgggagcgttcgtcaccagcaatctgagcggtggcgcgggcggcatttaagtgtgcggaggcgcattcccgccgcgctgcgtgacgcctgggctcccggcaccggactcgggacacgcgggaggccctcccgaaatagctgccgaatgaatgacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctggaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtgcctgtggcatttgatgatgtctccatctacttttccactccagagtgggaaaaattagaagaatggcaaaaggaactttacaagaatatcatgaagggcaactacgagtctctcatctccatggattatgctataaatcaacctgatgtcttatctcagattcaaccagaaggggaacataatacagaggaccaggcagggccagaggaaagtgagattcccacagaccccagtgaagagcctggtatttcaacatcagatattctgtcttggattaaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaa

SEQ ID NO: 202367 - DNA, 2232 bp, Homo sapiens
  Payload ID: 19916
  Gene Name: zinc finger protein 398
  Uniprot ID: Q8TD17
  ENST ID: ENST00000491174
  CDS Start-End: 680-2095
gcctgcacgcagccccgtagaatgagaaggggacggtcaggccgcggggaaagcactgatcgcatttgccacccaagaggtctttggtcacctctaggagagcaattgtactgggcacgcttactaatctgcttacaggaatggagaaagaatgattggactgattcaaggccggaggttagctgagcagacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctggaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaaggtgcctgtggcatttgatgatgtctccatctacttttccactccagagtgggaaaaattagaagaatggcaaaaggaactttacaagaatatcatgaagggcaactacgagtctctcatctccatggattatgctataaatcaacctgatgtcttatctcagattcaaccagaaggggaacataatacagaggaccaggcagggccagaggaaagtgagattcccacagaccccagtgaagagcctggtatttcaacatcagatattctgtcttggattaaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaacacccacagtaattattatctggcacatcaatgaatttggggtcctatacacttg

SEQ ID NO: 202368 - DNA, 2860 bp, Homo sapiens
  Payload ID: 19916
  Gene Name: zinc finger protein 398
  Uniprot ID: Q8TD17
  ENST ID: ENST00000475153
  CDS Start-End: 268-2196
agctgaggggccgctgcgggtggagtgcggcggagtcggcctcgcgaccccagcttgatccgccgcctgctgcaccgcgcctccgccgcgttcctgcgcgtcccgagccccgacggccgcgtgagtcccgtccgtgcggggaaggcagggccgggtcggcgccgcctgtggagaggacccggcggccgggcctgcttggagccgggcgcggtggcagcggcggcagcggcggcgacttccgaggcccgggctagacagcgcagggccatggctgaggcggccccggccccgacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctggaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaaggtgcctgtggcatttgatgatgtctccatctacttttccactccagagtgggaaaaattagaagaatggcaaaaggaactttacaagaatatcatgaagggcaactacgagtctctcatctccatggattatgctataaatcaacctgatgtcttatctcagattcaaccagaaggggaacataatacagaggaccaggcagggccagaggaaagtgagattcccacagaccccagtgaagagcctggtatttcaacatcagatattctgtcttggattaaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaacacccacagtaattattatctggcacatcaatgaatttggggtcctatacacttgactagagacatgcttgtgttttggaatttcacacccttacaagaataccacattttgaaacccagaaagacctggaaaggagcccagcatgtccatcttttcaaagatacaacaaaagcagaagttacaagaatattgcggagaggttggaaagcaggatttaacctctagttctcttgttctcagagaacagcaggttgatagtagattatgtctctaggtagagacagatacatgagaagagcctccaaaactggaagcccatcataaggcatgagaatgtttaactataaagccttttattagttctttgatagctaagatggttgttggagaaagtgcttaagccactgtttatgttgctgcctcctctctcaaaaccagccaagatctgttcacacacctctgtggctgtctttccctgaaacatggtaactcaagactgcctgcctaggtttcttagattaattattcacataaattttgtttaatattggttgaacaagaaatctgactttaaaagatta

SEQ ID NO: 202369 - DNA, 1844 bp, Homo sapiens
  Payload ID: 19917
  Gene Name: zinc finger protein 404
  ENST ID: ENST00000324394
  CDS Start-End: 1-1656
tttcaggtgccattgacattcagcgatgttgccatagacttctctcaggaggagtgggaatatttaaactcggatcagagggatttgtacagagatgtgatgttggagaattatactaacttggtctcattggactttaatttcacaactgaaagcaacaagttatcttcagaaaaaagaaattatgaagtaaatgcgtaccatcaggagacatggaaaagaaataaaaccttcaaccttatgaggtttattttcagaactgacccacagtacacaattgaatttgggagacaacagagacctaaagtgggatgttttagtcaaatgatattcaaaaaacataaatcccttcctctacataagagaaataacacaagagagaaatcatatgagtgtaaggaatataagaagggctttagaaaatatttgcaccttactgaacatctgagagaccatactggtgtgataccctatgaatgtaatgaatgtggaaaagcatttgtagttttccagcattttattagacatcgaaaaatccacactgatttgaaaccctatgaatgcaatggatgtgagaaggcctttaggttttattcacagcttattcagcatcagataattcatactggtatgaaaccctatgaatgtaagcaatgcgggaaggcttttagacgtcattctcaccttacagaacatcagaaaattcatgttggcttgaaaccctttgaatgtaaggaatgtggggaaacgtttagattatatcgacatatgtgtctgcatcagaaaattcatcatggtgtgaaaccctacaaatgtaaagaatgtggaaaggcttttggtcatcgttcaagtctttaccaacataagaaaattcattctggtgagaaaccatataaatgtgaacaatgtgaaaaggcctttgttcgcagctatctacttgttgaacatcaaagaagtcatactggtgagaaacctcatgaatgcatggaatgtggaaaggcttttggtaagggctcaagccttcttaaacataagagaattcatagtagtgagaaactctatgattgtaaggattgtggaaaggccttttgtagaggctctcaacttacacagcatcagagaattcatactggtgagaagccacatgaatgtaaagaatgtgggaagacttttaagcttcattcatatcttattcaacatcagataattcatactgatttgaagccatatgaatgtaagcaatgtgggaaagccttcagtcgtgttggagaccttaagacacatcaatcaattcatgctggggagaaaccctatgaatgtaaggaatgtggaaaaacctttagacttaattctcaactaatttatcatcagacaattcatactggtttgaaaccctatgtatgtaaagaatgtaagaaggcctttcgttctatctcaggtctttctcaacataagagaattcatactggtgaaaaaccctatgaatgtaaagaatgtgataaggcctttaatcgcagtgatcgacttactcaacatgagacaattcatactggtgtgaaaccacagaaatgcaaagaatgtggtaaggcctttagtcattgctatcaacttagtcaacatcaaagatttcaccatggtgagagactcttaatgtaatgagagggaaagcctttagccatggcacatttttactgttgtcactattatgatgctatagtgaagattaaactagttaatatagaatataaatacttggaaaggcatctggcacatcgtatttgcttactaaatacattatttttatgataattgttagaattactaaaaataaatcttatagaagg

SEQ ID NO: 202370 - DNA, 1851 bp, Homo sapiens
  Payload ID: 19917
  Gene Name: zinc finger protein 404
  Uniprot ID: Q494X3
  ENST ID: ENST00000587539
  CDS Start-End: 1-1659
atggcccgggtgccattgacattcagcgatgttgccatagacttctctcaggaggagtgggaatatttaaactcggatcagagggatttgtacagagatgtgatgttggagaattatactaacttggtctcattggactttaatttcacaactgaaagcaacaagttatcttcagaaaaaagaaattatgaagtaaatgcgtaccatcaggagacatggaaaagaaataaaaccttcaaccttatgaggtttattttcagaactgacccacagtacacaattgaatttgggagacaacagagacctaaagtgggatgttttagtcaaatgatattcaaaaaacataaatcccttcctctacataagagaaataacacaagagagaaatcatatgagtgtaaggaatataagaagggctttagaaaatatttgcaccttactgaacatctgagagaccatactggtgtgataccctatgaatgtaatgaatgtggaaaagcatttgtagttttccagcattttattagacatcgaaaaatccacactgatttgaaaccctatgaatgcaatggatgtgagaaggcctttaggttttattcacagcttattcagcatcagataattcatactggtatgaaaccctatgaatgtaagcaatgcgggaaggcttttagacgtcattctcaccttacagaacatcagaaaattcatgttggcttgaaaccctttgaatgtaaggaatgtggggaaacgtttagattatatcgacatatgtgtctgcatcagaaaattcatcatggtgtgaaaccctacaaatgtaaagaatgtggaaaggcttttggtcatcgttcaagtctttaccaacataagaaaattcattctggtgagaaaccatataaatgtgaacaatgtgaaaaggcctttgttcgcagctatctacttgttgaacatcaaagaagtcatactggtgagaaacctcatgaatgcatggaatgtggaaaggcttttggtaagggctcaagccttcttaaacataagagaattcatagtagtgagaaactctatgattgtaaggattgtggaaaggccttttgtagaggctctcaacttacacagcatcagagaattcatactggtgagaagccacatgaatgtaaagaatgtgggaagacttttaagcttcattcatatcttattcaacatcagataattcatactgatttgaagccatatgaatgtaagcaatgtgggaaagccttcagtcgtgttggagaccttaagacacatcaatcaattcatgctggggagaaaccctatgaatgtaaggaatgtggaaaaacctttagacttaattctcaactaatttatcatcagacaattcatactggtttgaaaccctatgtatgtaaagaatgtaagaaggcctttcgttctatctcaggtctttctcaacataagagaattcatactggtgaaaaaccctatgaatgtaaagaatgtgataaggcctttaatcgcagtgatcgacttactcaacatgagacaattcatactggtgtgaaaccacagaaatgcaaagaatgtggtaaggcctttagtcattgctatcaacttagtcaacatcaaagatttcaccatggtgagagactcttaatgtaatgagagggaaagcctttagccatggcacatttttactgttgtcactattatgatgctatagtgaagattaaactagttaatatagaatataaatacttggaaaggcatctggcacatcgtatttgcttactaaatacattatttttatgataattgttagaattactaaaaataaatcttatagaaggaaga

SEQ ID NO: 202371 - DNA, 7948 bp, Homo sapiens
  Payload ID: 19918
  Gene Name: zinc finger protein 407
  Uniprot ID: Q9C0G0
  ENST ID: ENST00000299687
  CDS Start-End: 1-6747
atgatggatagtgagaataaacccgaaaatgatgaggatgaaaagataaacaaagaagcacaagacttgacaaagctttcatcccataatgaagacggtgggcctgtatctgatgtgatagcaagtttccctgagaattctatgggcaaaagaggtttttcagaatcatcgaactctgatagtgttgttataggagaagacagaaataaacatgcttccaaacgcaggaaattagatgaggcagagccccttaaatctggaaagcaaggtatttgtagattagaaacttctgagagctcagtcacagaagggggtattgcattagatgaaacagggaaggagacctttctgagtgactgcacagttggaggcacatgtctcccaaatgccctctccccttcttgcaattttagcactattgatgttgtttctctgaaaacagacactgaaaaaacatctgctcaggaaatggtttcccttgatctggaaagagaatctcctttccccccgaaagaaattagtgttagttgtaccattgggaatgtagatacagttctcaaatgcagcatctgtgggcatttgttttcttcttgctctgacttggaaaaacatgctgagtctcacatgcagcagcctaaggaacatacctgttgtcactgcagccacaaagcagagagcagctcagcactacatatgcatatcaaacaagcacatgggccacagaaggtcttttcctgtgatctttgtggttttcagtgttcagaagaaaacttgttgaatgcacattatcttggcaaaacacatctccgtcgtcagaatctggctgctcgtggaggatttgtacagatcttaacaaaacaaccttttcctaaaaaatcacgtacaatggcaacaaaaaatgttcactcaaaaccaagaacttctaaatcaatagcaaagaatagtgattcaaaaggattacgaaatgtgggaagcacgtttaaagatttcagaggaagtatttctaaacaaagtggtagtagcagtgagcttcttgttgaaatgatgccttccagaaatactttgtcacaggaagtagagattgttgaagaacatgttacttcccttggtctagctcagaatcctgaaaaccagagtagaaagctagacaccttagtaacctcagagggtctcttagagaaattggaatctacaaaaaatacccttcaggcagcacacggtaacagtgtaacctcgaggccaagacctgagcgaaatattctcgtgttgggtaatagctttcgtcgacgaagcagcactttcaccttgaagggccaggcaaagaaaaggtttaatcttttaggaattaaaagaggtacaagtgaaactcagaggatgtatatgaaacacttgagaacacagatgaaaacacacgatgcagaatcagtgctgaaacacctggaagcgtgcagcagtgtgcagagagtgtgtgtgactacctcagaaacccaggaggcagagcagggccaggggagtgcccgtcctccggactccgggctgcattccctgacagtgaagccagcttctggctctcagacgttgtgtgcttgtacagactgtgggcaagtagctacaaataggacagatttggaaatccatgtgaaaaggtgccatgccagagagatgaaattttactgccgtacttgtgacttctctagtatgtcaagaagggacttagatgaacatttgcacagtaaccagcatcagcaaactgcttctgtcctgagttgtcagtgttgttcatttatatccttggatgaaataaatcttagagaccacatgaaggaaaagcacaatatgcattttctttgcaccccttgtaatctgttctttttgtctgaaaaagatgtggaagaacacaaagccaccgagaagcatattaattcattggttcaaccaaagactttgcaatcatctaacagtgatttggttttacagactttacctttgagtactttagaatcagaaaacgcaaaagagtctatggatgactcaggaaaagcatctcaggaagaacctctgaagtccagggtaagccatggtaatgaagtgaggcattccagtaagcctcagtttcagtgtaagaagtgtttttataaaacaagatcttctactgttctcacgagacatataaagcttcggcatggtcaagactatcattttctttgtaaagcttgtaatctttattcattgagcaaagaaggaatggagaaacacattaaaagaagcaagcatcttgaaaatgctaagaaaaataatattggcttaagctttgaagaatgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggccttttggcctctagtattacaaacttgactgttcacattagacgaaaacacagtcaccagtatagttatttatgcaaagtgtgtaagtattacactgtaactaagggagatatggaacgtcattgtgccaccaagaaacataaaggacgggtagaaatagaagcaagtggaaaacacagttcagatatcattgttggccctgaagggggtagccttgaagctggtaaaaagaatgctggctcagcagtgaccatgtcagatgaacatgctaacaaaccagctgagtcacccacctccgttttagagaagccagatcgtggaaactcaattgaagctgaagttgaaaatgtatttcattctctagatggagaagttaacagccatcttcttgataaaaaggagcaaatatcttcagagccagaggacttcgcccagccgggggatgtgtactcccagagagatgttacaggcacaggtgagaataagtgtttgcactgtgagtttagtgctcactcctctgcttctctagagctgcatgtaaaacggaaacatacaaaagagtttgagttttattgcatggcatgcgattactacgcggtgactcgtcgcgagatgaccaggcatgcagcaacagagaagcacaaaatgaaaaggcagtcttatctcaactctgctaatgtagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttttacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatctactaggcaagcatggagttggcaccccaaaagaaaggaaatttacatgccacttatgtgatagaagtttcacagagaagtgggccctgaacaaccacatgaaactccacacgggagaaaagccgtttaaatgtacctggcccacgtgccattactcattcctcacagcctccgcaatgaaagaccactacaggacgcacacaggcgagaagtcgtttctgtgtgacctctgcggctttgccggcgggacccgccacgccctcaccaagcatcgcagacagcacacaggagaaaaacctttcaagtgcgatgagtgtaactttgcctccacaactcagtcccatttgactcggcataaacgtgtccacactggagaaaagccctacagatgcccctggtgtgactacaggtcaaactgtgctgaaaatatccgcaaacacattctgcatactggcaaacatgaaggagtcaagatgtacaactgtcccaagtgtgactacgggaccaacgtcccggtggagttccggaaccatttgaaggaacagcatcctgacatcgaaaacccggacctcgcttacctgcatgctggcattgtttccaagtcgtacgagtgccgtctaaagggacaaggagccaccttcgtggagacagacagccccttcaccgcggcggccttggcagaagagcccctcgtcaaggagaagcccctcagaagcagcaggaggccagcgccgccccctgagcaggtgcagcaggtcatcatcttccagggctacgacggggagtttgccctggacccctcggtggaggagacggccgccgccacgctgcagacgctggccatggccggccaggtggcccgggtggtgcatatcacggaggatggccaggtcatcgccacgagtcagagcggggcacatgtaggcagcgtggtgcccggacccatcctccccgagcagctggctgatggagccacccaggtggtcgtcgtggggggctccatggaaggccacggcatggatgagtccctcagtccaggtggcgctgtgatacaacaggtgaccaagcaggagattttaaacctctcggaggctggagtcgctccccccgaggcatcctcagccctggatgcattgctctgtgcggtcactgaattaggggaggtggagggcagggctgggctcgaggagcaaggcaggcccggcgccaaagacgtgctgatccagctgcccgggcaggaggtctcccatgtggctgccgaccccgaggcccccgagatccagatgttcccacaggcccaggagagcccggccgccgtggaggtgctcacccaggtggtccatccctcagcagccatggcctctcaggagcgggcacaggtggccttcaagaagatggtccagggcgtcctccagtttgctgtgtgtgacacggccgcggccggccagttggtcaaggacggtgtcacccaggtggtggtgagcgaagagggtgccgtccacatggtcgccggggagggtgcccagatcatcatgcaggaggcgcagggcgagcacatggatctggtggagtccgacggggagatctcgcagatcatcgtgacggaggagctggtccaggccatggtgcaggagtccagtggcggcttctccgagggcaccacgcactacatcctgacagagctgcccccaggggtgcaggacgagccgggcctgtactcccacaccgtgctggagactgcggactcgcaggaactcctgcaggccggggccacgctaggcacagaggccggggccccaagcagggcagagcagctggccagcgtggtcatctacacccaggagggctcctcggccgcggcggcaattcagagccaaagagaaagcagcgaactccaggaagcatgagacgcgcggcacctttactcagcacagggcaggtgtgggaaggtccagcttcggtgggggaccgtgttccctgagcttcatctgaaaccttcaaaaccatgaggacaaggctcccgtgagctctgagcatgccctcccagcgagagtcacactggccaccagccaggcgcccacagagggtaccgtgggctgggcctcggggagcaggctgccaagtgcaggggagggccgggcgcaggccgcacagggagctccggtccactgggggcccttcgatcagtggcctcccgcttcgtcctggccgctgtgctgaagagaagccaagtgttgttggtgtttttctctcccaagtgttttcccatttcagttatcagaaggtcatggccgtggggaaagtggtgaagatacccctcctggcttggggtgcacctgcttgtgcagtcagcatgtagctgcctttccatttcattctctactgggctaaaaattgcagctacaagtgttaccatcttgaagcagtccacttccattcaattttttttttttaattttagaataacagtgtccccataccaaaggaagcctgctagctcatttcatgtataaatttcccatcttcaaacagtttaggtgtatttgttgctctggtcacattctgcataaaagaaatcctcttaagcctatggttaagaaaagccttgaagtttatattcagttaaaatatatgtcggtggagatagccagtgcttctaattttgacttagtttcatacagtaaagcctaaatgtgaaacgcacacgctggaagatattgttcctatcaatattttgctttttataacaagggtttgttcatattgatgccatttttgcaggatttcttcgtgatttctgtccatatgaaaatgctgacattaaacattaacacatggagaccgtgccctgtggccctgccgtggctgccagcatggtctgtgtttccttgtggattcacctgtggccctgctgtggccaccagcatggtctgtgtcctcgtggattcactgcagctgtcggatgcgagtttctgtcataatcatttgtttcctgatacaattgttcttattcttttccaaaactgtaaaataatctcctccctcaaatgcaaaggttgtttttgttctgtttctgttttctttgaaataaaattataacgttaaaag

SEQ ID NO: 202372 - DNA, 5595 bp, Homo sapiens
  Payload ID: 19918
  Gene Name: zinc finger protein 407
  Uniprot ID: Q9C0G0
  ENST ID: ENST00000309902
  CDS Start-End: 58-5040
acaggttatgagtgccagtgagccgccttagatagaagcatcgtcagcactttattaatgatggatagtgagaataaacccgaaaatgatgaggatgaaaagataaacaaagaagcacaagacttgacaaagctttcatcccataatgaagacggtgggcctgtatctgatgtgatagcaagtttccctgagaattctatgggcaaaagaggtttttcagaatcatcgaactctgatagtgttgttataggagaagacagaaataaacatgcttccaaacgcaggaaattagatgaggcagagccccttaaatctggaaagcaaggtatttgtagattagaaacttctgagagctcagtcacagaagggggtattgcattagatgaaacagggaaggagacctttctgagtgactgcacagttggaggcacatgtctcccaaatgccctctccccttcttgcaattttagcactattgatgttgtttctctgaaaacagacactgaaaaaacatctgctcaggaaatggtttcccttgatctggaaagagaatctcctttccccccgaaagaaattagtgttagttgtaccattgggaatgtagatacagttctcaaatgcagcatctgtgggcatttgttttcttcttgctctgacttggaaaaacatgctgagtctcacatgcagcagcctaaggaacatacctgttgtcactgcagccacaaagcagagagcagctcagcactacatatgcatatcaaacaagcacatgggccacagaaggtcttttcctgtgatctttgtggttttcagtgttcagaagaaaacttgttgaatgcacattatcttggcaaaacacatctccgtcgtcagaatctggctgctcgtggaggatttgtacagatcttaacaaaacaaccttttcctaaaaaatcacgtacaatggcaacaaaaaatgttcactcaaaaccaagaacttctaaatcaatagcaaagaatagtgattcaaaaggattacgaaatgtgggaagcacgtttaaagatttcagaggaagtatttctaaacaaagtggtagtagcagtgagcttcttgttgaaatgatgccttccagaaatactttgtcacaggaagtagagattgttgaagaacatgttacttcccttggtctagctcagaatcctgaaaaccagagtagaaagctagacaccttagtaacctcagagggtctcttagagaaattggaatctacaaaaaatacccttcaggcagcacacggtaacagtgtaacctcgaggccaagacctgagcgaaatattctcgtgttgggtaatagctttcgtcgacgaagcagcactttcaccttgaagggccaggcaaagaaaaggtttaatcttttaggaattaaaagaggtacaagtgaaactcagaggatgtatatgaaacacttgagaacacagatgaaaacacacgatgcagaatcagtgctgaaacacctggaagcgtgcagcagtgtgcagagagtgtgtgtgactacctcagaaacccaggaggcagagcagggccaggggagtgcccgtcctccggactccgggctgcattccctgacagtgaagccagcttctggctctcagacgttgtgtgcttgtacagactgtgggcaagtagctacaaataggacagatttggaaatccatgtgaaaaggtgccatgccagagagatgaaattttactgccgtacttgtgacttctctagtatgtcaagaagggacttagatgaacatttgcacagtaaccagcatcagcaaactgcttctgtcctgagttgtcagtgttgttcatttatatccttggatgaaataaatcttagagaccacatgaaggaaaagcacaatatgcattttctttgcaccccttgtaatctgttctttttgtctgaaaaagatgtggaagaacacaaagccaccgagaagcatattaattcattggttcaaccaaagactttgcaatcatctaacagtgatttggttttacagactttacctttgagtactttagaatcagaaaacgcaaaagagtctatggatgactcaggaaaagcatctcaggaagaacctctgaagtccagggtaagccatggtaatgaagtgaggcattccagtaagcctcagtttcagtgtaagaagtgtttttataaaacaagatcttctactgttctcacgagacatataaagcttcggcatggtcaagactatcattttctttgtaaagcttgtaatctttattcattgagcaaagaaggaatggagaaacacattaaaagaagcaagcatcttgaaaatgctaagaaaaataatattggcttaagctttgaagaatgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggccttttggcctctagtattacaaacttgactgttcacattagacgaaaacacagtcaccagtatagttatttatgcaaagtgtgtaagtattacactgtaactaagggagatatggaacgtcattgtgccaccaagaaacataaaggacgggtagaaatagaagcaagtggaaaacacagttcagatatcattgttggccctgaagggggtagccttgaagctggtaaaaagaatgctggctcagcagtgaccatgtcagatgaacatgctaacaaaccagctgagtcacccacctccgttttagagaagccagatcgtggaaactcaattgaagctgaagttgaaaatgtatttcattctctagatggagaagttaacagccatcttcttgataaaaaggagcaaatatcttcagagccagaggacttcgcccagccgggggatgtgtactcccagagagatgttacaggcacaggtgagaataagtgtttgcactgtgagtttagtgctcactcctctgcttctctagagctgcatgtaaaacggaaacatacaaaagagtttgagttttattgcatggcatgcgattactacgcggtgactcgtcgcgagatgaccaggcatgcagcaacagagaagcacaaaatgaaaaggcagtcttatctcaactctgctaatgtagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttttacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatctactaggcaagcatggagttggcaccccaaaagaaagagtaaaggttgcatatcgaaagatcgggacgttgccaggaatacagaacaacaggaacgcgtcgagtgcctctgaagcccaaagtctttgtgagcacttttcataactgatgggacctgcagtgggaggattggctgaggacttattttggttgaagttagacatatttcattgtctttttttttttccttttatctgtgtacttctttgcatacttgaattcatttgtgtgatgtaaatcatcacacaaatgtaggctagtctagtgattttctggaaggaactgttattttaaaaattgagtactcagttttataaaattgtcatcatcaatgagttaaaaaaaaaaaaacccttaatgattcagggtttatttaaagctgactgtccaatcaaagtttttgtaagcatgccatgtgacaaatgcctggcatattcagtaaggaacatattaattattctaattaacacatgacttcagagaagtctttcgttaatcagcacatggatcttggttatttgtacccttttgggaaaatttcacactcagatgcaaaaataccaggctaaatacattgctttgtttgtatgtggagaggatattcatcacaatggtactatacatctaagaaaacagaaagtaattaaaatgctgattact

SEQ ID NO: 202373 - DNA, 5662 bp, Homo sapiens
  Payload ID: 19918
  Gene Name: zinc finger protein 407
  Uniprot ID: Q9C0G0
  ENST ID: ENST00000582337
  CDS Start-End: 122-5104
aaagggaagacggtgagccggaggagtcagtcagaggggcgagcaggagcgattccgtcgccaaacaggttatgagtgccagtgagccgccttagatagaagcatcgtcagcactttattaatgatggatagtgagaataaacccgaaaatgatgaggatgaaaagataaacaaagaagcacaagacttgacaaagctttcatcccataatgaagacggtgggcctgtatctgatgtgatagcaagtttccctgagaattctatgggcaaaagaggtttttcagaatcatcgaactctgatagtgttgttataggagaagacagaaataaacatgcttccaaacgcaggaaattagatgaggcagagccccttaaatctggaaagcaaggtatttgtagattagaaacttctgagagctcagtcacagaagggggtattgcattagatgaaacagggaaggagacctttctgagtgactgcacagttggaggcacatgtctcccaaatgccctctccccttcttgcaattttagcactattgatgttgtttctctgaaaacagacactgaaaaaacatctgctcaggaaatggtttcccttgatctggaaagagaatctcctttccccccgaaagaaattagtgttagttgtaccattgggaatgtagatacagttctcaaatgcagcatctgtgggcatttgttttcttcttgctctgacttggaaaaacatgctgagtctcacatgcagcagcctaaggaacatacctgttgtcactgcagccacaaagcagagagcagctcagcactacatatgcatatcaaacaagcacatgggccacagaaggtcttttcctgtgatctttgtggttttcagtgttcagaagaaaacttgttgaatgcacattatcttggcaaaacacatctccgtcgtcagaatctggctgctcgtggaggatttgtacagatcttaacaaaacaaccttttcctaaaaaatcacgtacaatggcaacaaaaaatgttcactcaaaaccaagaacttctaaatcaatagcaaagaatagtgattcaaaaggattacgaaatgtgggaagcacgtttaaagatttcagaggaagtatttctaaacaaagtggtagtagcagtgagcttcttgttgaaatgatgccttccagaaatactttgtcacaggaagtagagattgttgaagaacatgttacttcccttggtctagctcagaatcctgaaaaccagagtagaaagctagacaccttagtaacctcagagggtctcttagagaaattggaatctacaaaaaatacccttcaggcagcacacggtaacagtgtaacctcgaggccaagacctgagcgaaatattctcgtgttgggtaatagctttcgtcgacgaagcagcactttcaccttgaagggccaggcaaagaaaaggtttaatcttttaggaattaaaagaggtacaagtgaaactcagaggatgtatatgaaacacttgagaacacagatgaaaacacacgatgcagaatcagtgctgaaacacctggaagcgtgcagcagtgtgcagagagtgtgtgtgactacctcagaaacccaggaggcagagcagggccaggggagtgcccgtcctccggactccgggctgcattccctgacagtgaagccagcttctggctctcagacgttgtgtgcttgtacagactgtgggcaagtagctacaaataggacagatttggaaatccatgtgaaaaggtgccatgccagagagatgaaattttactgccgtacttgtgacttctctagtatgtcaagaagggacttagatgaacatttgcacagtaaccagcatcagcaaactgcttctgtcctgagttgtcagtgttgttcatttatatccttggatgaaataaatcttagagaccacatgaaggaaaagcacaatatgcattttctttgcaccccttgtaatctgttctttttgtctgaaaaagatgtggaagaacacaaagccaccgagaagcatattaattcattggttcaaccaaagactttgcaatcatctaacagtgatttggttttacagactttacctttgagtactttagaatcagaaaacgcaaaagagtctatggatgactcaggaaaagcatctcaggaagaacctctgaagtccagggtaagccatggtaatgaagtgaggcattccagtaagcctcagtttcagtgtaagaagtgtttttataaaacaagatcttctactgttctcacgagacatataaagcttcggcatggtcaagactatcattttctttgtaaagcttgtaatctttattcattgagcaaagaaggaatggagaaacacattaaaagaagcaagcatcttgaaaatgctaagaaaaataatattggcttaagctttgaagaatgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggccttttggcctctagtattacaaacttgactgttcacattagacgaaaacacagtcaccagtatagttatttatgcaaagtgtgtaagtattacactgtaactaagggagatatggaacgtcattgtgccaccaagaaacataaaggacgggtagaaatagaagcaagtggaaaacacagttcagatatcattgttggccctgaagggggtagccttgaagctggtaaaaagaatgctggctcagcagtgaccatgtcagatgaacatgctaacaaaccagctgagtcacccacctccgttttagagaagccagatcgtggaaactcaattgaagctgaagttgaaaatgtatttcattctctagatggagaagttaacagccatcttcttgataaaaaggagcaaatatcttcagagccagaggacttcgcccagccgggggatgtgtactcccagagagatgttacaggcacaggtgagaataagtgtttgcactgtgagtttagtgctcactcctctgcttctctagagctgcatgtaaaacggaaacatacaaaagagtttgagttttattgcatggcatgcgattactacgcggtgactcgtcgcgagatgaccaggcatgcagcaacagagaagcacaaaatgaaaaggcagtcttatctcaactctgctaatgtagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttttacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatctactaggcaagcatggagttggcaccccaaaagaaagagtaaaggttgcatatcgaaagatcgggacgttgccaggaatacagaacaacaggaacgcgtcgagtgcctctgaagcccaaagtctttgtgagcacttttcataactgatgggacctgcagtgggaggattggctgaggacttattttggttgaagttagacatatttcattgtctttttttttttccttttatctgtgtacttctttgcatacttgaattcatttgtgtgatgtaaatcatcacacaaatgtaggctagtctagtgattttctggaaggaactgttattttaaaaattgagtactcagttttataaaattgtcatcatcaatgagttaaaaaaaaaaaaacccttaatgattcagggtttatttaaagctgactgtccaatcaaagtttttgtaagcatgccatgtgacaaatgcctggcatattcagtaaggaacatattaattattctaattaacacatgacttcagagaagtctttcgttaatcagcacatggatcttggttatttgtacccttttgggaaaatttcacactcagatgcaaaaataccaggctaaatacattgctttgtttgtatgtggagaggatattcatcacaatggtactatacatctaagaaaacagaaagtaattaaaatgctgattactata

SEQ ID NO: 202374 - DNA, 5794 bp, Homo sapiens
  Payload ID: 19918
  Gene Name: zinc finger protein 407
  Uniprot ID: Q9C0G0
  ENST ID: ENST00000577538
  CDS Start-End: 1-5448
atgatggatagtgagaataaacccgaaaatgatgaggatgaaaagataaacaaagaagcacaagacttgacaaagctttcatcccataatgaagacggtgggcctgtatctgatgtgatagcaagtttccctgagaattctatgggcaaaagaggtttttcagaatcatcgaactctgatagtgttgttataggagaagacagaaataaacatgcttccaaacgcaggaaattagatgaggcagagccccttaaatctggaaagcaaggtatttgtagattagaaacttctgagagctcagtcacagaagggggtattgcattagatgaaacagggaaggagacctttctgagtgactgcacagttggaggcacatgtctcccaaatgccctctccccttcttgcaattttagcactattgatgttgtttctctgaaaacagacactgaaaaaacatctgctcaggaaatggtttcccttgatctggaaagagaatctcctttccccccgaaagaaattagtgttagttgtaccattgggaatgtagatacagttctcaaatgcagcatctgtgggcatttgttttcttcttgctctgacttggaaaaacatgctgagtctcacatgcagcagcctaaggaacatacctgttgtcactgcagccacaaagcagagagcagctcagcactacatatgcatatcaaacaagcacatgggccacagaaggtcttttcctgtgatctttgtggttttcagtgttcagaagaaaacttgttgaatgcacattatcttggcaaaacacatctccgtcgtcagaatctggctgctcgtggaggatttgtacagatcttaacaaaacaaccttttcctaaaaaatcacgtacaatggcaacaaaaaatgttcactcaaaaccaagaacttctaaatcaatagcaaagaatagtgattcaaaaggattacgaaatgtgggaagcacgtttaaagatttcagaggaagtatttctaaacaaagtggtagtagcagtgagcttcttgttgaaatgatgccttccagaaatactttgtcacaggaagtagagattgttgaagaacatgttacttcccttggtctagctcagaatcctgaaaaccagagtagaaagctagacaccttagtaacctcagagggtctcttagagaaattggaatctacaaaaaatacccttcaggcagcacacggtaacagtgtaacctcgaggccaagacctgagcgaaatattctcgtgttgggtaatagctttcgtcgacgaagcagcactttcaccttgaagggccaggcaaagaaaaggtttaatcttttaggaattaaaagaggtacaagtgaaactcagaggatgtatatgaaacacttgagaacacagatgaaaacacacgatgcagaatcagtgctgaaacacctggaagcgtgcagcagtgtgcagagagtgtgtgtgactacctcagaaacccaggaggcagagcagggccaggggagtgcccgtcctccggactccgggctgcattccctgacagtgaagccagcttctggctctcagacgttgtgtgcttgtacagactgtgggcaagtagctacaaataggacagatttggaaatccatgtgaaaaggtgccatgccagagagatgaaattttactgccgtacttgtgacttctctagtatgtcaagaagggacttagatgaacatttgcacagtaaccagcatcagcaaactgcttctgtcctgagttgtcagtgttgttcatttatatccttggatgaaataaatcttagagaccacatgaaggaaaagcacaatatgcattttctttgcaccccttgtaatctgttctttttgtctgaaaaagatgtggaagaacacaaagccaccgagaagcatattaattcattggttcaaccaaagactttgcaatcatctaacagtgatttggttttacagactttacctttgagtactttagaatcagaaaacgcaaaagagtctatggatgactcaggaaaagcatctcaggaagaacctctgaagtccagggtaagccatggtaatgaagtgaggcattccagtaagcctcagtttcagtgtaagaagtgtttttataaaacaagatcttctactgttctcacgagacatataaagcttcggcatggtcaagactatcattttctttgtaaagcttgtaatctttattcattgagcaaagaaggaatggagaaacacattaaaagaagcaagcatcttgaaaatgctaagaaaaataatattggcttaagctttgaagaatgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggccttttggcctctagtattacaaacttgactgttcacattagacgaaaacacagtcaccagtatagttatttatgcaaagtgtgtaagtattacactgtaactaagggagatatggaacgtcattgtgccaccaagaaacataaaggacgggtagaaatagaagcaagtggaaaacacagttcagatatcattgttggccctgaagggggtagccttgaagctggtaaaaagaatgctggctcagcagtgaccatgtcagatgaacatgctaacaaaccagctgagtcacccacctccgttttagagaagccagatcgtggaaactcaattgaagctgaagttgaaaatgtatttcattctctagatggagaagttaacagccatcttcttgataaaaaggagcaaatatcttcagagccagaggacttcgcccagccgggggatgtgtactcccagagagatgttacaggcacaggtgagaataagtgtttgcactgtgagtttagtgctcactcctctgcttctctagagctgcatgtaaaacggaaacatacaaaagagtttgagttttattgcatggcatgcgattactacgcggtgactcgtcgcgagatgaccaggcatgcagcaacagagaagcacaaaatgaaaaggcagtcttatctcaactctgctaatgtagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttttacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatctactaggcaagcatggagttggcaccccaaaagaaaggaaatttacatgccacttatgtgatagaagtttcacagagaagtgggccctgaacaaccacatgaaactccacacgggagaaaagccgtttaaatgtacctggcccacgtgccattactcattcctcacagcctccgcaatgaaagaccactacaggacgcacacaggcgagaagtcgtttctgtgtgacctctgcggctttgccggcgggacccgccacgccctcaccaagcatcgcagacagcacacaggagaaaaacctttcaagtgcgatgagtgtaactttgcctccacaactcagtcccatttgactcggcataaacgtgtccacactggagaaaagccctacagatgcccctggtgtgactacaggtcaaactgtgctgaaaatatccgcaaacacattctgcatactggcaaacatgaaggagtcaagatgtacaactgtcccaagtgtgactacgggaccaacgtcccggtggagttccggaaccatttgaaggaacagcatcctgacatcgaaaacccggacctcgcttacctgcatgctggtaagggacagaaactgtgaaaacttgtttctaacaggatttcatgtgatcacagcagttataatgctatttgtacattaccatgatttattgtaatggagtagagtatgtgatagtatctgcttcaagacctatagaaaagtacattccagtttgatcccactcaactatgaaaacaggacttttcaactgtattttatcaaaaaaggaaatctgacagagtaattatttgatgactgtaaagttaataatagtaaatatttaaagcatagttgacctgaaatgagagtagttgttaaatcttcatatgttgactaattgctaaaattttaattttttttcttaaaaaatgcttgtgatttgaaa

SEQ ID NO: 202375 - DNA, 793 bp, Homo sapiens
  Payload ID: 19918
  Gene Name: zinc finger protein 407
  ENST ID: ENST00000581829
  CDS Start-End: 1-413
catgccacttatgtgatagaagtttcacagagaagtgggccctgaacaaccacatgaaactccacacgggagaaaagccgtttaaatgtacctggcccacgtgccattactcattcctcacagcctccgcaatgaaagaccactacaggacgcacacaggcgagaagtcgtttctgtgtgacctctgcggctttgccggcgggacccgccacgccctcaccaagcatcgcagacagcacacaggagaaaaacctttcaagtgcgatgagtgtaactttgcctccacaactcagtcccatttgactcggcataaacgtgtccacactggagaaaagccctacagatgcccctggtgtgactacagcttctttgtttccacatattctgaaatattgcctgtctggagcctgtagaaaaaatgtgaaagacagaaagacaaactttgaacatttggaaaatggtgatgccgtcgtttttatgaagcagaggaagacagagcagcttatgtatcagcgtgtctgactcattccactccctctaggcataagatgctgccttctgtgtggtagcatttattgtgtatattttggctcatccctaagaatttctttaagacaatattatatcttttataaattttacatctttgtcttcttaattagggaatgtagcacaaattttttgttggattttttttcctattcatattattttcgtacttaactacatttattagaagttctagaaaaagaactacttctgaggttttgttttgttttggtaaaacaatgtt

SEQ ID NO: 202376 - DNA, 1013 bp, Homo sapiens
  Payload ID: 19918
  Gene Name: zinc finger protein 407
  ENST ID: ENST00000584235
  CDS Start-End: 1-390
aaatttacatgccacttatgtgatagaagtttcacagagaagtgggccctgaacaaccacatgaaactccacacgggagaaaagccgtttaaatgtacctggcccacgtgccattactcattcctcacagcctccgcaatgaaagaccactacaggacgcacacaggcgagaagtcgtttctgtgtgacctctgcggctttgccggcgggacccgccacgccctcaccaagcatcgcagacagcacacaggagaaaaacctttcaagtgcgatgagtgtaactttgcctccacaactcagtcccatttgactcggcataaacgtgtccacactggagaaaagccctacagatgcccctggtgtgactacagtgcctatgattgggtctgaaaggctggccttgctcccagacgtttagaaaagcagctagatgtgcacaggtttcctgcgggtgacagagaggccagcgcagcgcctgctgttcaggagcgtctcagaggcacacgagagccggttggctgctcgcgcagagagcgcatgtggacacctggacagccgcgtgacttggaagcatgggagtttatcctctcaagggtggtggatgagaccaagaatgcgtcagtgttcatccacttctgtgctaacttacaagtttctttctcttatgaggcactgtgctgttttagaatcactttttatcgcataataaacatgaacagaaatataactgagaaatggagagaaaaattcaatgtgcatcaatttgtcctaagaactagtttcaaagaatttagatttatgaaaagcaaaaagtaatgagtaaatgatctaatggaaattatcccattcaataaatagctaccagttataataaaggaaaataaaattcataagatttagagcaaggtgatccagaaactctccaactaaaatttcctcttgctgaaaatgtccaaaggattgtattttgtgattacctcagattgctgtaaactctttttatctgaataaaa

SEQ ID NO: 202377 - DNA, 2442 bp, Homo sapiens
  Payload ID: 19919
  Gene Name: zinc finger protein 408
  Uniprot ID: Q9H9D4
  ENST ID: ENST00000311764
  CDS Start-End: 231-2393
gctttcccagctagtcgaatcactggtgcacctccggaatccgaggttcgcattgctctcggacagagttctgcctccccagtactcccaaactcccagtcctgtgcaccaatgaggtccagctctgaggcttctttcctgagaaaaaaatttggaagtccgtgactgtttcctggaggagctgagaagaggaagctcacttccggcgtagggaggctttctgacccggaatggaggaggcggaggagctgctcttggaggggaagaaggcgctgcaactcgcccgcgagccgcgcctgggcctggacttaggatggaacccttccggagaaggctgtacgcagggcctcaaagacgtcccacccgagccgacccgagacatcctcgctttaaagagccttccccggggcttggcccttggcccctcactcgccaaggaacagcgcttgggggtctggtgtgtcggggaccccctgcagcccggcctgctgtgggggccgctggaagaggagtctgcctccaaggagaagggcgagggagtaaagccacggcaggaggagaacctgtcattaggcccatggggagacgtgtgtgcctgtgagcagagttctggctggactagcttggtacaacggggcaggctggagagtgagggaaatgtggccccagtgcggatcagcgagaggcttcatctgcaagtgtaccagctggtgctgccaggctctgaactgctgctgtggccccagccttcctctgagggcccaagtctcacccagcctgggctggacaaagaggcagctgtagcagtggtgacagaagtggagtctgctgtacagcaggaagtggcctcccctggggaggatgcagcagaaccttgcatagatcctggttcccagtcaccctctggcatccaggcagagaatatggtgagccctggacttaagttcccaacccaggaccgaatttccaaggatagccagccacttggcccattgcttcaggatggcgacgtggatgaggaatgcccggcccaggcacagatgccacctgaacttcagagcaattcggctacccagcaggacccagatggcagtggagccagtttctcatcttctgccaggggcacccagccgcatggctacctggccaagaagttacacagccccagtgatcagtgcccacccagagcaaagaccccagagcctggagcccagcagtctggcttccctacactctcgcggagccctcctggcccagcaggaagctccccaaagcaggggcgacggtaccggtgtggagagtgtggcaaggcattcctacagctgtgccacctaaagaagcacgcatttgtgcacacgggccacaagccctttctttgcactgagtgtggcaagagctatagctcagaggagagcttcaaagcccatatgctgggccaccgtggggtgcggcccttcccctgtccacaatgcgacaaggcctatggcacccagcgagacctcaaagagcaccaggtggtacattcaggtgcccggccctttgcttgtgaccagtgtggcaaggcctttgcccgccggccctccctgcggctgcatcgcaagacccaccaggtgccagctgcccctgccccttgcccatgccctgtgtgtgggcggcccctggccaaccagggctccctgcggaaccatatgaggctccatacaggagaaaagcctttcctgtgcccgcactgtggccgggcgtttcgtcagcggggcaacctgcgtgggcatttgcggctccacaccggggagcgtccttaccgctgcccacactgtgccgatgccttcccccagctgcctgaactgcggcgccatctcatctcacacaccggggaggcccacttgtgcccggtgtgtggcaaggccctccgagacccacacacgctccgagctcacgagcgcctgcactccggagagaggccctttccctgtccccagtgtggccgtgcttacacgctggccaccaagctgcggcgccacctcaaatctcacttggaggacaagccctaccgctgccccacctgtggcatgggctacaccctcccgcagagcctcaggcggcatcagctcagtcaccggcctgaggcaccctgcagcccaccctctgtgccttctgctgcttctgagcccactgtggtgctcctgcaggctgagccacaactgctggacacacacagagaggaggaagtctcccccgccagggatgttgttgaggtcaccatttcagaaagccaggagaagtgctttgtggtgccagaggagccagatgccgcccccagcctggtgctaatccataaggacatgggcctcggcgcctgggcagaggtggtggaggtggagatgggcacctgacagctttgccttttgctgacacagctccataaagactcgtgctttctca

SEQ ID NO: 202378 - DNA, 4297 bp, Homo sapiens
  Payload ID: 19920
  Gene Name: zinc finger protein 41
  Uniprot ID: P51814
  ENST ID: ENST00000313116
  CDS Start-End: 407-2746
gtaagggcacccaccaggtgtaattgtgggcgagcggccgcttcggagctgacactaagcatgtgcagatcaagtccagaagcgccggggttcctcgaagcagttttcaggacttaaggctctgggacatccagcacagtgagcggcccctgggcaccaccagaaaacatttgtgagtgaacgtggagtgatgaccatgtggacactgtctttccagggtttcttggagcctctgcagagtctgggggccaggcttcttagtggaaactgcaggatcttccttctgacccctgcttgcctcgccccagcagctccggttgagtccacagatgccagctcagcttccagcttggggaagagtggggttgtcagcaggagagcctgagggctgaggcccagcgtgaacatggcagctaatggggactctcccccatggtccccggccctggctgcagagggacgtggcagctcatgtgaggcttcagtgtcatttgaggacgtgactgtggacttcagcaaggaggagtggcagcacttggaccctgcccagagacgcctgtactgggatgtgacactagagaactacagccacctgctctcagtggggtaccaaattcccaagtcagaggctgccttcaagttggagcaaggagaggggccatggatgctggagggggaagccccacatcagagctgttcaggtgaggctattgggaaaatgcagcaacagggaattcctggaggaattttcttccactgtgagagatttgatcaacccataggagaagattcattatgttctattttagaagaactgtggcaagataatgaccagctagagcaacgtcaggaaaaccagaataaccttttaagtcatgtgaaagtattgattaaggagaggggctatgaacataaaaacattgaaaaaataattcatgtgactaccaagcttgttccttcaattaaaagactccataactgtgacacaattttgaagcatactttaaactcacataatcataatagaaacagtgcaacaaagaaccttggcaagatttttggaaatggtaacaatttcccccatagcccttcctctactaagaatgagaatgctaaaacaggagcaaattcctgtgaacatgaccactatgaaaaacatctcagccacaaacaagctcccacccaccatcagaaaattcatcctgaggagaagctttatgtgtgtactgaatgtgtaatgggcttcactcagaagtcacatctgtttgagcatcagagaattcatgctggagaaaagtcccgtgaatgtgacaaaagcaacaaagtcttcccccagaaaccccaggttgatgtacatccaagtgtttatacaggagaaaaaccctatctgtgtactcaatgtgggaaagtctttaccctcaaatcaaacctcattacacatcaaaaaattcataccgggcagaaaccctacaaatgcagtgaatgtggaaaagcctttttccagagatcagacctctttagacatctgagaattcatacaggagaaaaaccttatgaatgcagtgaatgtggaaaaggcttctcccagaactcagacctcagtatacatcagaaaactcataccggagagaaacactatgaatgcaatgaatgtgggaaggctttcacaagaaaatcagcactcaggatgcatcagagaatccacacgggagagaaaccttatgtatgcgctgactgtgggaaggccttcatccagaaatcacatttcaacacacatcagagaattcatactggagaaaagccgtatgaatgcagtgactgtgggaaatccttcactaagaagtcacaactccatgtgcatcaaagaattcacaccggagagaaaccctatatatgtacagaatgtggaaaggtcttcactcacaggacaaacctcaccacacatcagaaaactcatactggggaaaaaccctatatgtgtgctgaatgtggaaaggcttttactgaccagtcaaatctcattaaacaccagaaaactcacactggagagaaaccctataagtgcaatggctgtggaaaagccttcatatggaagtcgcgcctcaaaatacatcagaaatctcatattggagagagacactatgaatgcaaggactgcgggaaagccttcatccagaaatcaacactaagcgtgcatcagagaatccatacaggagagaaaccgtacgtttgtcctgaatgcgggaaggcctttatccagaaatcgcacttcattgcgcatcatagaatccatactggagagaagccttatgaatgcagcgactgtgggaaatgcttcactaagaagtcacaactccgtgtgcatcagaaaatccacacaggtgagaagcccaatatatgtgctgaatgtggaaaggccttcactgaccgatcaaatctcataacacatcagaaaatccacactagggagaaaccctatgaatgtggtgactgcgggaaaaccttcacctggaagtcacgcctcaatatacatcagaagtctcatactggagaaagacactatgaatgtagtaaatgtgggaaagctttcatccagaaagccacactaagtatgcatcagataattcatacaggaaagaaaccttatgcttgtacagaatgtcagaaggcctttactgacagatcgaatctcattaaacaccagaaaatgcatagtggagaaaaacgctataaagccagtgactgagaaagtcttcacctggaaatcacaactgggtatgcatcaggtatctaatagcagggaggaggaaggcctgttgctgcaatcattgtacagggggaaatgggtatgagagactgaggcttgagtgaactgaaggcaaacagagccaagtatccttcagtccactggaaagacaagttcctgcatcaccacagtgtatatgcaattctatgcataggaagagcctttagagaaagcatttgagcgaaagtcatgtttggtgacatgattcatacagacctcttgagctcctggaaatagtagaattaagacctgaggagatgactcgtcatctcttatgcttcactttttggataaagaactttttaaattcagtactgattggttcagcatatcctgggacataaaaatactcactactgggaaaaactttttcaaatttctaggttgaggagaagagttttcattgtccaaacactggcagggcactgacatcaaggcagaaaacctacttgggaatgcagatatctgtttttgtgatcattggcacttaagacatagaaaagatttccatgaaaaacttttttcttttcccttgggaagtcctcatggtatatatattttaagtgcaatggaatttttaaatttaaagatataactttatgaattgagaaattaggcctagctctaggctatgttacagaaatatagtcattgaatgatacagacatataaaggtagtagttgtctcattattaattccctgctgggagagcagatgagtcataccctataagaagtatgcatgccttctaacctatgtccccaaagctgtcatttgcataagctgcaggccatagattcctgattccctcagtaactgaccctacgacaatggaactgatccacggcactctagattttcaggctaacccaccaacacccctgctttccttgggatttcctgaaaaagaatggttgaaaaattgagtttcacttcctaatattttgtttttcttcctatttggttaaggtatattcatttcctacatgcacattaagggtagttttgtgtagactgctatgtgataaagtcatgttgcattgcaattagttattctaagacataattacagtttatcatagttgaataactggaagacttctcaagaaagagcactgctcttttttaacactgatatatagacacgttctcattttcccttaaacattttttacaatactcataaaaaggaactttctttctagcatgcaattgtatttttattttattttaaaatctttttattaaactataatgtatacagaaaatgcatatatcataaacatacagctcagtgcattctcaaaaactgaacatactcagatcaagaaacagaacatgaccagcaccccagaagccttccccactttcccttccaggcaagcccccaagggtatacattatcctggcttctcacagcatagattcattttgcctgttttgtattttatataaattgagtcaattatatatcatataattgagccata

SEQ ID NO: 202379 - DNA, 4531 bp, Homo sapiens
  Payload ID: 19920
  Gene Name: zinc finger protein 41
  Uniprot ID: P51814
  ENST ID: ENST00000377065
  CDS Start-End: 641-2980
cggaggctccccggtagggacggcctgaggccgagggcaccctgagggcggaagaggcaaagcgcctcgcccgccggggcctcggaggtgactaactcctagaggctgcggcggaggggagaagcctggtggtacattccatggcccagtgcctcggccactggaaaatcccacaggggtatatcgagtaggggaccgcgggctccgcggcagaaatgaccgcccttccaagatggcggctcccgtagagacactcccaaggagacagccatgttccttgcctgagagtcactgaaggaaattggaaagcccgcctctccttcgacgcacacgcgcacgcgcacgcacgcaccggcgcggtcatccagcacagtgagcggcccctgggcaccaccagaaaacatttgtgagtgaacgtggagtgatgaccatgtggacactgtctttccagggtttcttggagcctctgcagagtctgggggccaggcttcttagtggaaactgcaggatcttccttctgacccctgcttgcctcgccccagcagctccggttgagtccacagatgccagctcagcttccagcttggggaagagtggggttgtcagcaggagagcctgagggctgaggcccagcgtgaacatggcagctaatggggactctcccccatggtccccggccctggctgcagagggacgtggcagctcatgtgaggcttcagtgtcatttgaggacgtgactgtggacttcagcaaggaggagtggcagcacttggaccctgcccagagacgcctgtactgggatgtgacactagagaactacagccacctgctctcagtggggtaccaaattcccaagtcagaggctgccttcaagttggagcaaggagaggggccatggatgctggagggggaagccccacatcagagctgttcaggtgaggctattgggaaaatgcagcaacagggaattcctggaggaattttcttccactgtgagagatttgatcaacccataggagaagattcattatgttctattttagaagaactgtggcaagataatgaccagctagagcaacgtcaggaaaaccagaataaccttttaagtcatgtgaaagtattgattaaggagaggggctatgaacataaaaacattgaaaaaataattcatgtgactaccaagcttgttccttcaattaaaagactccataactgtgacacaattttgaagcatactttaaactcacataatcataatagaaacagtgcaacaaagaaccttggcaagatttttggaaatggtaacaatttcccccatagcccttcctctactaagaatgagaatgctaaaacaggagcaaattcctgtgaacatgaccactatgaaaaacatctcagccacaaacaagctcccacccaccatcagaaaattcatcctgaggagaagctttatgtgtgtactgaatgtgtaatgggcttcactcagaagtcacatctgtttgagcatcagagaattcatgctggagaaaagtcccgtgaatgtgacaaaagcaacaaagtcttcccccagaaaccccaggttgatgtacatccaagtgtttatacaggagaaaaaccctatctgtgtactcaatgtgggaaagtctttaccctcaaatcaaacctcattacacatcaaaaaattcataccgggcagaaaccctacaaatgcagtgaatgtggaaaagcctttttccagagatcagacctctttagacatctgagaattcatacaggagaaaaaccttatgaatgcagtgaatgtggaaaaggcttctcccagaactcagacctcagtatacatcagaaaactcataccggagagaaacactatgaatgcaatgaatgtgggaaggctttcacaagaaaatcagcactcaggatgcatcagagaatccacacgggagagaaaccttatgtatgcgctgactgtgggaaggccttcatccagaaatcacatttcaacacacatcagagaattcatactggagaaaagccgtatgaatgcagtgactgtgggaaatccttcactaagaagtcacaactccatgtgcatcaaagaattcacaccggagagaaaccctatatatgtacagaatgtggaaaggtcttcactcacaggacaaacctcaccacacatcagaaaactcatactggggaaaaaccctatatgtgtgctgaatgtggaaaggcttttactgaccagtcaaatctcattaaacaccagaaaactcacactggagagaaaccctataagtgcaatggctgtggaaaagccttcatatggaagtcgcgcctcaaaatacatcagaaatctcatattggagagagacactatgaatgcaaggactgcgggaaagccttcatccagaaatcaacactaagcgtgcatcagagaatccatacaggagagaaaccgtacgtttgtcctgaatgcgggaaggcctttatccagaaatcgcacttcattgcgcatcatagaatccatactggagagaagccttatgaatgcagcgactgtgggaaatgcttcactaagaagtcacaactccgtgtgcatcagaaaatccacacaggtgagaagcccaatatatgtgctgaatgtggaaaggccttcactgaccgatcaaatctcataacacatcagaaaatccacactagggagaaaccctatgaatgtggtgactgcgggaaaaccttcacctggaagtcacgcctcaatatacatcagaagtctcatactggagaaagacactatgaatgtagtaaatgtgggaaagctttcatccagaaagccacactaagtatgcatcagataattcatacaggaaagaaaccttatgcttgtacagaatgtcagaaggcctttactgacagatcgaatctcattaaacaccagaaaatgcatagtggagaaaaacgctataaagccagtgactgagaaagtcttcacctggaaatcacaactgggtatgcatcaggtatctaatagcagggaggaggaaggcctgttgctgcaatcattgtacagggggaaatgggtatgagagactgaggcttgagtgaactgaaggcaaacagagccaagtatccttcagtccactggaaagacaagttcctgcatcaccacagtgtatatgcaattctatgcataggaagagcctttagagaaagcatttgagcgaaagtcatgtttggtgacatgattcatacagacctcttgagctcctggaaatagtagaattaagacctgaggagatgactcgtcatctcttatgcttcactttttggataaagaactttttaaattcagtactgattggttcagcatatcctgggacataaaaatactcactactgggaaaaactttttcaaatttctaggttgaggagaagagttttcattgtccaaacactggcagggcactgacatcaaggcagaaaacctacttgggaatgcagatatctgtttttgtgatcattggcacttaagacatagaaaagatttccatgaaaaacttttttcttttcccttgggaagtcctcatggtatatatattttaagtgcaatggaatttttaaatttaaagatataactttatgaattgagaaattaggcctagctctaggctatgttacagaaatatagtcattgaatgatacagacatataaaggtagtagttgtctcattattaattccctgctgggagagcagatgagtcataccctataagaagtatgcatgccttctaacctatgtccccaaagctgtcatttgcataagctgcaggccatagattcctgattccctcagtaactgaccctacgacaatggaactgatccacggcactctagattttcaggctaacccaccaacacccctgctttccttgggatttcctgaaaaagaatggttgaaaaattgagtttcacttcctaatattttgtttttcttcctatttggttaaggtatattcatttcctacatgcacattaagggtagttttgtgtagactgctatgtgataaagtcatgttgcattgcaattagttattctaagacataattacagtttatcatagttgaataactggaagacttctcaagaaagagcactgctcttttttaacactgatatatagacacgttctcattttcccttaaacattttttacaatactcataaaaaggaactttctttctagcatgcaattgtatttttattttattttaaaatctttttattaaactataatgtatacagaaaatgcatatatcataaacatacagctcagtgcattctcaaaaactgaacatactcagatcaagaaacagaacatgaccagcaccccagaagccttccccactttcccttccaggcaagcccccaagggtatacattatcctggcttctcacagcatagattcattttgcctgttttgtattttatataaattgagtcaattatatatcatataattgagccata

SEQ ID NO: 202380 - DNA, 613 bp, Homo sapiens
  Payload ID: 19920
  Gene Name: zinc finger protein 41
  ENST ID: ENST00000432977
  CDS Start-End: 78-613
agcttccagcttggggaagagtggggttgtcagcaggagagcctgagggctgaggcccagcgtgaacatggcagctaatggggactctcccccatggtccccggccctggctgcagagggacgtggcagctcatgtgagtgctgaccatgctgccttgaacagcattgtgtcgttacaggcttcagtgtcatttgaggacgtgactgtggacttcagcaaggaggagtggcagcacttggaccctgcccagagacgcctgtactgggatgtgacactagagaactacagccacctgctctcagtggggtaccaaattcccaagtcagaggctgccttcaagttggagcaaggagaggggccatggatgctggagggggaagccccacatcagagctgttcaggtgaggctattgggaaaatgcagcaacagggaattcctggaggaattttcttccactgtgagagatttgatcaacccataggagaagattcattatgttctattttagaagaactgtggcaagataatgaccagctagagcaacgtcaggaaaaccagaataaccttttaagtcatgtgaaagtattgattaaggagaggggctatgaaca

SEQ ID NO: 202381 - DNA, 2293 bp, Homo sapiens
  Payload ID: 19921
  Gene Name: zinc finger protein 410
  Uniprot ID: Q86VK4
  ENST ID: ENST00000324593
  CDS Start-End: 261-1556
gccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 202382 - DNA, 2193 bp, Homo sapiens
  Payload ID: 19921
  Gene Name: zinc finger protein 410
  ENST ID: ENST00000334521
  CDS Start-End: 210-1487
aggttacattgattacccacctagtacaacatcttacgggaagagcatagtatttcctagaggaatatgaacataacaggaagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggt

SEQ ID NO: 202383 - DNA, 2461 bp, Homo sapiens
  Payload ID: 19921
  Gene Name: zinc finger protein 410
  Uniprot ID: Q86VK4
  ENST ID: ENST00000398139
  CDS Start-End: 195-1013
aattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagaggtggagtcttgctatgttgcccaggctggagtgcagtggcaccatctcggctcactgcaacctctacctcccgaattcaagcggttcttctgcctcagcctcctgagtagctgggaccacagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 202384 - DNA, 2076 bp, Homo sapiens
  Payload ID: 19921
  Gene Name: zinc finger protein 410
  Uniprot ID: Q86VK4
  ENST ID: ENST00000442160
  CDS Start-End: 195-1745
aattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagaacctgttccatggagagaagaggatggaaagtcaggctgcagtgacttgaatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagagtctcgctccgttgcccaggctggagtgcagtggtgcgttctcggctcactgcaacctctgcctcccaggttcaagcgattctcctgcctcagcctcctgagtagctgctactacagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaag

SEQ ID NO: 202385 - DNA, 1722 bp, Homo sapiens
  Payload ID: 19921
  Gene Name: zinc finger protein 410
  Uniprot ID: Q86VK4
  ENST ID: ENST00000540593
  CDS Start-End: 449-1666
aggagtcccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatact

SEQ ID NO: 202386 - DNA, 587 bp, Homo sapiens
  Payload ID: 19921
  Gene Name: zinc finger protein 410
  ENST ID: ENST00000557495
  CDS Start-End: 207-587
gtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagtgttgtcttttctccccccagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttct

SEQ ID NO: 202387 - DNA, 888 bp, Homo sapiens
  Payload ID: 19921
  Gene Name: zinc finger protein 410
  ENST ID: ENST00000554582
  CDS Start-End: 265-555
atctggattttggacattgttaggtttgagatgctgttggatatacatgtggagatacctagcaagcagttagaaatgaaggtttggagttcagaagagatgactagagaaaaatgttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagct

SEQ ID NO: 202388 - DNA, 1232 bp, Homo sapiens
  Payload ID: 19921
  Gene Name: zinc finger protein 410
  ENST ID: ENST00000556179
  CDS Start-End: 903-1232
agaggtttttgtattttgcattcccagcaaaatacaatcagcaatgatgattgctgtaccatgtgtttgtcaattgtgaatttgttcctagcatttagaaattgggagattctacttaaaaatccttatttccagtgtcttaaaaaaaaatcagagaatctgccttaatctacccatggcaacagttggctagagctgaataacagctgccccttttctaggtactctctaggttactgcagcccccacttggccattttacttacttttgctacctatcagtctcctatagacatgagtttttgacccctgctctaagtatggttttctgggtaggtagaatggagacggagagtttgggacttgaagacatagaggacaatttagattattatgttgtaagagccaccagtgtgaatgttgatgaccctaaagagggtggcagggaatatgacaaggggatattaggaacacaggattgaaatccttgaggaaagcacatgtcctagaggtccatggaagactaactgaaaaagaaggcatattttttgtggttgccatggtcctataccaaagaggttttgtgaaggcagcattacagaaggtctggaaaggaccagcagctgggagcagggagtgtgctaaagccctcctggtgtactcttcctgccttcccccatatactgaagtttgagaggctgggaaggtgcggaatgggaaaaggagcagctgcttatgttcagtttaacattctctgggtttctccatctaggtcttgagttcattctcttcctgtccttttggcttccttgtttaacctggtccctgtttcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagaggta

SEQ ID NO: 202389 - DNA, 1311 bp, Homo sapiens
  Payload ID: 19921
  Gene Name: zinc finger protein 410
  ENST ID: ENST00000556797
  CDS Start-End: 635-1138
agagatacattctgagaaatatgatggtagttgatatcattattatgcgaacatggtagagtatacttacacaaacctgtatggtttagcctgctacactctaggctgtatggtataccttattgcccctaggctgcaaacctatacagcatgttactgtactgaatactgtaggcagttgaagcacagtggtaaacattgtgtatctaaacatatctaaacgtggaaaaagtacaataaaaataggatattacaatctcacaggaccatcatcctatatgtggtctgttaactgaaatgtcgttttgcagcacatgactttatataaatcagctgttctctagaacagagaacttgataaaataactttagatattatgttgtttagtttttgtttgaatatggatgagactagtgaacagtcttaatattatcttttggtaaattcaaaggtttagatacatttctaacaactcgtatttctcagtgttgtcttttctccccccagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggtgaggcccgtcggcattttccttgccactattctgtgcaaagagattttggtaatgcagtggctggtttgagttgtatataatttaaattattctattgatgagagcagaaggctagaaatctgtaaattgtttaaattttattttctataaaataacttggtcatgccagatttgtgttcaaaaccaactagtattctgaattctcaactttaaataatgtacagagccccttttaaagaaaaaataatataca

SEQ ID NO: 202390 - DNA, 537 bp, Homo sapiens
  Payload ID: 19921
  Gene Name: zinc finger protein 410
  ENST ID: ENST00000554797
  CDS Start-End: 327-537
ttttatgggttttgatgcctgttgagcttgttgtattttaaaagaagtgtttcggtttgaattctttatttgcttgcttgttgtgattttttttgtatatgtaaagaagtgtctttatgtacctgtgttttcccactgctcttaatgccccctctctcttttttacccctattctaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtccctt

SEQ ID NO: 202391 - DNA, 841 bp, Homo sapiens
  Payload ID: 19921
  Gene Name: zinc finger protein 410
  ENST ID: ENST00000556160
  CDS Start-End: 618-841
tggcgggcccgggagcggccagtctgaagccctgcggctttggcccttcccctcgcgggtttttaggggcgatgttcttgctcctttgcttggttttgggggtagggatataggaacagactgtcctgagaaagccagagtcagcgagtccccggggcgggggctcttggactgcacccgcagccggggcctgcctacggaccttggggccttatttctgaggcctttgtggtgtggggtagaggatgccaggaggccttgccctgaatgtttcagtccagagctaccctctcctttcataccacttactttctgggtttggaaaagggacagctgcctactcggctgggctgggtcgcccgtttctcctttgcctgtttgagatgctgttggatatacatgtggagatacctagcaagcagttagaaatgaaggtttggagttcagaagagatgactagagaaaaatgttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgtttt

SEQ ID NO: 202392 - DNA, 663 bp, Homo sapiens
  Payload ID: 19921
  Gene Name: zinc finger protein 410
  ENST ID: ENST00000557214
  CDS Start-End: 1-508
gtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagaggtggagtcttgctatgttgcccaggctggagtgcagtggcaccatctcggctcactgcaacctctacctcccgaattcaagcggttcttctgcctcagcctcctgagtagctgggaccacagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgctttt

SEQ ID NO: 202393 - DNA, 769 bp, Homo sapiens
  Payload ID: 19921
  Gene Name: zinc finger protein 410
  ENST ID: ENST00000554316
  CDS Start-End: 488-769
atgttgcccatgctagtctcggaacacctgggctcaagcagtcctcccaccttggcttcccaaagtgcttgggattataggtgtgagcaccatgcctggccaagtttctgctgttaagtgcatacaaagataactggggaagatgaagatagatacctgattaatgatcactaggagtaaaatataggagctttattgtttgagcctaagtatctgagtagggtctttccctggattacaaatatgtgactctgttacaggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctg

SEQ ID NO: 202394 - DNA, 2601 bp, Homo sapiens
  Payload ID: 19921
  Gene Name: zinc finger protein 410
  Uniprot ID: Q86VK4
  ENST ID: ENST00000555044
  CDS Start-End: 195-1631
aattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtcagttctttggctcttgttttatacaaaatttgttttcttagagattaagaatttaatctttccctttaaaatagtgtattgatttacccttaggattccataccagtaaaactgaaccgaggagtcttaggaaacaacaagaacatcttcatttcttaagcccaggtgatagttactctgtcaccaccaaaaaagacgcatctgagaaaatggcaataaaaacagatacttctg

SEQ ID NO: 202395 - DNA, 567 bp, Homo sapiens
  Payload ID: 19921
  Gene Name: zinc finger protein 410
  ENST ID: ENST00000555730
  CDS Start-End: 309-567
gtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgt

SEQ ID NO: 202396 - DNA, 1961 bp, Homo sapiens
  Payload ID: 19921
  Gene Name: zinc finger protein 410
  ENST ID: ENST00000556396
  CDS Start-End: 258-548
aaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctg

SEQ ID NO: 202397 - DNA, 595 bp, Homo sapiens
  Payload ID: 19921
  Gene Name: zinc finger protein 410
  ENST ID: ENST00000556659
  CDS Start-End: 219-595
gtgtgtggacggaattcgggaccgactgacggccggccggcttcccggaactggaaggtgagctccgaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacct

SEQ ID NO: 202398 - DNA, 571 bp, Homo sapiens
  Payload ID: 19921
  Gene Name: zinc finger protein 410
  ENST ID: ENST00000557363
  CDS Start-End: 184-571
gtgtgtggacggaattcgggaccgactgacggccggccggcttcccggaactggaagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcac

SEQ ID NO: 202399 - DNA, 1551 bp, Homo sapiens
  Payload ID: 19921
  Gene Name: zinc finger protein 410
  Uniprot ID: Q86VK4
  ENST ID: ENST00000615736
  CDS Start-End: 1-1551
atgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagaacctgttccatggagagaagaggatggaaagtcaggctgcagtgacttgaatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagagtctcgctccgttgcccaggctggagtgcagtggtgcgttctcggctcactgcaacctctgcctcccaggttcaagcgattctcctgcctcagcctcctga

SEQ ID NO: 202400 - DNA, 1178 bp, Homo sapiens
  Payload ID: 19922
  Gene Name: zinc finger protein 414
  Uniprot ID: Q96IQ9
  ENST ID: ENST00000255616
  CDS Start-End: 103-1041
atggcgctgacgtgagcgcgaactcgcactgcccagagggtggccgccgcctaagctgcagccgccggagccgcagaaacaagaggccgagccgtgtcgaagatggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcagcagggctcctccccagccccagacagctgccagcctggccccggacccagccctggcctgaccagcatagtctccgggaccagcgaggacctgcggcctcccagacgacgcccacctccagggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcaggtgcgtgcaggtgaccaccagggaggggtggaggggctttctttcctgcgccctgcggggtctggtggataccaggaggcagcagtgctcatccccttcccagggggcacaaatgccaccgtcccgaaatacaggatttttgccttaaaaa

SEQ ID NO: 202401 - DNA, 2300 bp, Homo sapiens
  Payload ID: 19922
  Gene Name: zinc finger protein 414
  Uniprot ID: Q96IQ9
  ENST ID: ENST00000393927
  CDS Start-End: 115-1287
gagaggtggaaaatggcgctgacgtgagcgcgaactcgcactgcccagagggtggccgccgcctaagctgcagccgccggagccgcagaaacaagaggccgagccgtgtcgaagatggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcagcagggctcctccccagccccagacagctgccagcctggccccggacccagccctggcctgaccagcatagtctccgggaccagcgaggacctgcggcctcccagacgacgcccacctccagggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcagggcacgcggccccgagccgcatcgtgtgggagcacacacgcggccgctactcgtgcatgcagtgcgccttctccacggcctcgcggcccgccatgaccctgcacctggaggaccaccgccccggcgcccccgcggcccccgcggccgggccgccgcgccccgacgcccccgcggatccggccccgcttgcacccaaggtgtcgccgctgctgtcagagggggagcttccagtgttctcgcagctctgaatcccgccgctttgggggtgggccatgggatgtgggtagttttgtcatttggagggggctgcagggaaggggggctggggtggacaataaagaaggcgccatgagccagcctatgctgtgttcccatcccttgtccatccaaagcatagtgggctcgagcccagcagtcatggattgatcacatcttgggaggaccacctgggtccacaggtgcaggcctcacagcccacctgtgtcctgtcttcccatcaccccaatcctgggacccaggtccccacctccagctgtggttgaggtccccagtacccactgtggcagcgttctcccttgtccagaaaccaaatgggatggggactctccagttttctttttttttttttttctttttttttttttcttttttgagacagtcttgctctgtctcccaggccggagtgcagtggcacaatctcctctcactgcaagctccacctcctgggttcacgccattctcctgcttcagcctcccaagtagctgggattacaggtgcccaccactatgcccggctaattttttgtatttttaatagagatggagtttcaccgcgttagccaggatggtctcgatctcctgacctcatgatccgcccgccttagactcccaaagtgctggaattacaggcgtgagccaccacgcccggtctccagttttcttttaagaagtcccggccgggcacagtggctcacgcctgtaatcccagcactttgggaggctggggcaggtggagcacctgaggtcaggagttcgagaccagcctgacttacatggtaaaaccccatctctactaaacacaaaaaattagccaggtgtggtggcgcacacctgtagtcccagctacttgggaggctgaggcaggagaatcacttgaacctgggaggtggaagttgcagtgagctgagattgtgctattgcactccagtctgggcaatacgagtggaactccatctcaaaaataaagaaaattaaaaagcaa

SEQ ID NO: 202402 - DNA, 579 bp, Homo sapiens
  Payload ID: 19922
  Gene Name: zinc finger protein 414
  ENST ID: ENST00000596772
  CDS Start-End: 1-361
aagccccccgcgcctgcgccccttcctggccgctgcacccgggccgccggcttccagcgccgccgtctggaaaaagagccaaggtgctggcagcagcccccgaagaccccagggcggctccgacgcgccctcagggcacgcggccccgagccgcatcgtgtgggagcacacacgcggccgctactcgtgcatgcagtgcgccttctccacggcctcgcggcccgccatgaccctgcacctggaggaccaccgccccggcgcccccgcggcccccgcggccgggccgccgcgccccgacgcccccgcgggtaaggccgaggaatgcgcgggtggagaggggggcgggggcccaaggcgctgaggctcaggcgcccccctcctctgccccacccagatccggccccgcttgcacccaaggtgtcgccgctgctgtcagagggggagcttccagtgttctcgcagctctgaatcccgccgctttgggggtgggccatgggatgtgggtagttttgtcatttggagggggctgcagggaaggggggctggggtggacaataaagaaggcgccatgagccagcc

SEQ ID NO: 202403 - DNA, 462 bp, Homo sapiens
  Payload ID: 19922
  Gene Name: zinc finger protein 414
  ENST ID: ENST00000594748
  CDS Start-End: 1-462
tgcactacaaacccaatcgctacttcaagtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcaggtgcgtgcagggcacgcggccccgagccgcatcgtgtgg

SEQ ID NO: 202404 - DNA, 418 bp, Homo sapiens
  Payload ID: 19922
  Gene Name: zinc finger protein 414
  ENST ID: ENST00000599379
  CDS Start-End: 108-245
ggaaaatggcgctgacgtgagcgcgaactcgcactgcccagagggtggccgccgcctaagctgcagccgccggagccgcagaaacaagaggccgagccgtgtcgaagatgggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgtgagaactgcctcctgcgcttccgcacgcaccgctcgctcttcaagcacctgcatgtttgcgcggagcatgcgcagagcccagccccgccg

SEQ ID NO: 202405 - DNA, 512 bp, Homo sapiens
  Payload ID: 19922
  Gene Name: zinc finger protein 414
  ENST ID: ENST00000593661
  CDS Start-End: 1-512
atcgctacttcaagttcccacccgaagtggtcaggaagggtcgctgccacagttgtacaggagcggggaggtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcagggcacgcggccccgagccgcatcgtgtgggagcacacacgcggccgc

SEQ ID NO: 202406 - DNA, 2270 bp, Homo sapiens
  Payload ID: 19923
  Gene Name: zinc finger protein 415
  Uniprot ID: Q09FC8
  ENST ID: ENST00000243643
  CDS Start-End: 105-1772
aaacggatcgcgttgggtgaaggtgacggcgtcgagccattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatatgttaaaactcacacaacatgatatatattaaaggttgcaggatgtttgaagtca

SEQ ID NO: 202407 - DNA, 2402 bp, Homo sapiens
  Payload ID: 19923
  Gene Name: zinc finger protein 415
  Uniprot ID: Q09FC8
  ENST ID: ENST00000421033
  CDS Start-End: 238-1905
gcatgcgcagtttcctacaggcccggaaacggatcgcgttgggtgaaggtgacggcgtcgagcgtgagtgaccctctgtgtagattaaacctgcgctccctgtttcccatttccacagccgatgtccagggtcgatacggcccttaaaatccccgtacactccaccccagcattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatatgttaaaactcacacaacatgatatatattaaaggttgcaggatgtttgaagtc

SEQ ID NO: 202408 - DNA, 2496 bp, Homo sapiens
  Payload ID: 19923
  Gene Name: zinc finger protein 415
  Uniprot ID: Q09FC8
  ENST ID: ENST00000500065
  CDS Start-End: 335-2002
ggatcgcgttgggtgaaggtgacggcgtcgagcgtgagtgaccctctgtgtagattaaacctgcgctccctgtttcccatttccacagccgatgtccagggtcgatacggcccttaaaatccccgtacactccaccccaggtgggagacaatgccttggagctgcaaatcttctctgagtctgaagcatcctgcctgacgcgtttgctcacattgacccgtgccttccctcagtccttctcatctctactgagattccgtctcaccctgaccctgtgacatgaacttctgaagagtccactgggcatggtcctgggaagggctcacacccagacatggatggagacgggttgacattcagggacgtggccatcgaattctctcaagatgagtggaaatgcctgaactctacacagaggactttatacagggatgtgatgttggagaactacaggaacctggtctccctggatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatatgttaaaactcacacaacatgatatatattaaaggttgcaggatgtttgaa

SEQ ID NO: 202409 - DNA, 2469 bp, Homo sapiens
  Payload ID: 19923
  Gene Name: zinc finger protein 415
  ENST ID: ENST00000597503
  CDS Start-End: 206-427
atcgcgttgggtgaaggtgacggcgtcgagcgtgagtgaccctctgtgtagattaaacctgcgctccctgtttcccatttccacagccgatgtccagggtcgatacggcccttaaaatccccgtacactccaccccagcattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctgggctggagtgcaatggtgcaatctcggctcactgcaaccttcgcctcccggattcaaatgattctcctgcctcagcctcccgagtagctgggattacagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatatgttaaaactcacacaacatgatatatattaaaggttgcaggatgtttgaagtca

SEQ ID NO: 202410 - DNA, 563 bp, Homo sapiens
  Payload ID: 19923
  Gene Name: zinc finger protein 415
  ENST ID: ENST00000600574
  CDS Start-End: 220-447
aggcccggaaacggatcgcgttgggtgaaggtgacggcgtcgagcgtgagtgaccctctgtgtagattaaacctgcgctccctgtttcccatttccacagccgatgtccagggtcgatacggcccttaaaatccccgtacactccaccccagcattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctgggtgaggataattttcttccagaagtcaaaatctgcccttggtatctttccattttcccttgtgtgcctcttgggagcccctgcattacctgactgagtttgaggccttgttgactctgaaatgaaaagctccataatgtgaactctggagtttaaccatcccctttttccagattttctgaccccttcatgatacaacagtggtggtt

SEQ ID NO: 202411 - DNA, 2461 bp, Homo sapiens
  Payload ID: 19923
  Gene Name: zinc finger protein 415
  ENST ID: ENST00000597748
  CDS Start-End: 217-438
tctgacctcatctcctgcctgtgtcctcctcgctccctctgctccagccaagcatgcgtccttcctgttcctgggccgagcttgctcctgcctcaaggccttcacgtgggctgtgcctctgctggaactcgctggcccctcagctgcagcattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctgggctggagtgcaatggtgcaatctcggctcactgcaaccttcgcctcccggattcaaatgattctcctgcctcagcctcccgagtagctgggattacagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatatgttaaaactcacacaacatgatatatattaaaggt

SEQ ID NO: 202412 - DNA, 580 bp, Homo sapiens
  Payload ID: 19923
  Gene Name: zinc finger protein 415
  ENST ID: ENST00000595813
  CDS Start-End: 244-465
aggcccggaaacggatcgcgttgggtgaaggtgacggcgtcgagcaaaggtgggagacaatgccttggagctgcaaatcttctctgagtctgaagcatcctgcctgacgcgtttgctcacattgacccgtgccttccctcagtccttctcatctctactgagattccgtctcaccctgaccctgtgacatgaacttctgaagagtccactgggcatggtcctgggaagggctcacacccagacatggatggagacgggttgacattcagggacgtggccatcgaattctctcaagatgagtggaaatgcctgaactctacacagaggactttatacagggatgtgatgttggagaactacaggaacctggtctccctgggctggagtgcaatggtgcaatctcggctcactgcaaccttcgcctcccggattcaaatgattctcctgcctcagcctcccgagtagctgggattacagatctgtctcgtaactgtgtaatcaaggaactagcaccacaacaggaaggtaacccaggagaagtattccacacagtgacattggaacaacatgaaaaacatga

SEQ ID NO: 202413 - DNA, 589 bp, Homo sapiens
  Payload ID: 19923
  Gene Name: zinc finger protein 415
  ENST ID: ENST00000601110
  CDS Start-End: 272-589
ctacaggcccggaaacggatcgcgttgggtgaaggtgacggcgtcgagcgacctctctgacctcatctcctgcctgtgtcctcctcgctccctctgctccagccaagcatgcgtccttcctgttcctgggccgagcttgctcctgcctcaaggccttcacgtgggctgtgcctctgctggaactcgctggcccctcagctgcagcattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaat

SEQ ID NO: 202414 - DNA, 601 bp, Homo sapiens
  Payload ID: 19923
  Gene Name: zinc finger protein 415
  ENST ID: ENST00000599261
  CDS Start-End: 228-557
cgcgttgggtgaaggtgacggcgtcgagcaaaggtgggagacaatgccttggagctgcaaatcttctctgagtctgaagcatcctgcctgacgcgtttgctcacattgacccgtgccttccctcagtccttctcatctctactgagattccgtctcaccctgaccctgtgacatgaacttctgaagagtccactgggcatggtcctgggaagggctcacacccagacatggatggagacgggttgacattcagggacgtggccatcgaattctctcaagatgagtggaaatgcctgaactctacacagaggactttatacagggatgtgatgttggagaactacaggaacctggtctccctggagtattatcctatgtgggagcacaggaaagagccctggaccatagaaagccaagtacgagtagcaagaaaaccaaaagggtgggaatggatcaaaggtgtgaaaacaggctggagtgcaatggtgcaatctcggctcactgcaaccttcgcctcccggattcaaatgattctcctgcctcagcctcccgagtagctgggattacagatctgtctcgtaactgtgtaatcaaggaacta

SEQ ID NO: 202415 - DNA, 551 bp, Homo sapiens
  Payload ID: 19923
  Gene Name: zinc finger protein 415
  ENST ID: ENST00000595174
  CDS Start-End: 61-551
taattcagccacatctcctccttctcactcaactcagacctctcaggataacttggtgaaatgactccctctctcagcctcagtgagcccacctgtaacagagataagggactagaccagaaaacctcaatcattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatct

SEQ ID NO: 202416 - DNA, 557 bp, Homo sapiens
  Payload ID: 19923
  Gene Name: zinc finger protein 415
  ENST ID: ENST00000597877
  CDS Start-End: 51-362
acatctcctccttctcactcaactcagacctctcaggataacttggtgaaatgactccctctctcagcctcagtgagcccacctgtaacagagataagggactagaccagaaaacctcaatgacctctctgacctcatctcctgcctgtgtcctcctcgctccctctgctccagccaagcatgcgtccttcctgttcctgggccgagcttgctcctgcctcaaggccttcacgtgggctgtgcctctgctggaactcgctggcccctcagctgcagcattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggatccatctgtgatagcctctcttcttatccaagcaaagggctgagattcttgaaaagccacagcacatcatgttccat

SEQ ID NO: 202417 - DNA, 2581 bp, Homo sapiens
  Payload ID: 19923
  Gene Name: zinc finger protein 415
  ENST ID: ENST00000600120
  CDS Start-End: 195-374
tgaaggtgacggcgtcgagcgtgagtgaccctctgtgtagattaaacctgcgctccctgtttcccatttccacagccgatgtccagggtcgatacggcccttaaaatccccgtacactccaccccagcattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggatccatctgtgatagcctctcttcttatccaagcaaagggctgagattcttgaaaagccacagcacatcatgttccattcattttataagcgggaaattctcttcctgaccagagtattatcctatgtgggagcacaggaaagagccctggaccatagaaagccaagtacgagtagcaagaaaaccaaaagggtgggaatggatcaaaggtgtgaaaacagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatatgttaaaactcacacaacatgatatatattaaaggttgcaggatgtttgaagtca

SEQ ID NO: 202418 - DNA, 571 bp, Homo sapiens
  Payload ID: 19923
  Gene Name: zinc finger protein 415
  ENST ID: ENST00000598024
  CDS Start-End: 117-296
ctacaggcccggaaacggatcgcgttgggtgaaggtgacggcgtcgagccattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggatccatctgtgatagcctctcttcttatccaagcaaagggctgagattcttgaaaagccacagcacatcatgttccattcattttataagcgggaaattctcttcctgaccagagtattatcctatgtgggagcacaggaaagagccctggaccatagaaagccaagtacgagtagcaagaaaaccaaaagggtgggaatggatcaaaggtgtgaaaacagatggagtttcgctcttattgcccaggctggagtgcaatggtgcaatctcggctcactgcaaccttcgcctcccggattcaaatgattctcctgcctca

SEQ ID NO: 202419 - DNA, 2479 bp, Homo sapiens
  Payload ID: 19923
  Gene Name: zinc finger protein 415
  ENST ID: ENST00000595193
  CDS Start-End: 108-437
cggaaacggatcgcgttgggtgaaggtgacggcgtcgagccattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggagtattatcctatgtgggagcacaggaaagagccctggaccatagaaagccaagtacgagtagcaagaaaaccaaaagggtgggaatggatcaaaggtgtgaaaacaggctggagtgcaatggtgcaatctcggctcactgcaaccttcgcctcccggattcaaatgattctcctgcctcagcctcccgagtagctgggattacagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatatgttaaaactcacacaacatgatatatattaaaggttgcaggatgtttgaagtca

SEQ ID NO: 202420 - DNA, 2630 bp, Homo sapiens
  Payload ID: 19923
  Gene Name: zinc finger protein 415
  ENST ID: ENST00000594011
  CDS Start-End: 260-589
aaacggatcgcgttgggtgaaggtgacggcgtcgagcgacctctctgacctcatctcctgcctgtgtcctcctcgctccctctgctccagccaagcatgcgtccttcctgttcctgggccgagcttgctcctgcctcaaggccttcacgtgggctgtgcctctgctggaactcgctggcccctcagctgcagcattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggagtattatcctatgtgggagcacaggaaagagccctggaccatagaaagccaagtacgagtagcaagaaaaccaaaagggtgggaatggatcaaaggtgtgaaaacaggctggagtgcaatggtgcaatctcggctcactgcaaccttcgcctcccggattcaaatgattctcctgcctcagcctcccgagtagctgggattacagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatatgttaaaactcacacaacatgatatatattaaaggttgcaggatgtttgaagtc

SEQ ID NO: 202421 - DNA, 2258 bp, Homo sapiens
  Payload ID: 19923
  Gene Name: zinc finger protein 415
  ENST ID: ENST00000598578
  CDS Start-End: 94-273
gttgggtgaaggtgacggcgtcgagccattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggatccatctgtgatagcctctcttcttatccaagcaaagggctgagattcttgaaaagccacagcacatcatgttccattcattttataagcgggaaattctcttcctgaccagagtattatcctatgtgggagcacaggaaagagccctggaccatagaaagccaagtacgagtagcaagaaaaccaaaagggtgggaatggatcaaaggtgtgaaaacagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcact

SEQ ID NO: 202422 - DNA, 561 bp, Homo sapiens
  Payload ID: 19923
  Gene Name: zinc finger protein 415
  ENST ID: ENST00000601215
  CDS Start-End: 17-337
aggataacttggtgaaatgactccctctctcagcctcagtgagcccacctgtaacagagataagggactagaccagaaaacctcaatgacctctctgacctcatctcctgcctgtgtcctcctcgctccctctgctccagccaagcatgcgtccttcctgttcctgggccgagcttgctcctgcctcaaggccttcacgtgggctgtgcctctgctggaactcgctggcccctcagctgcagcattgacttccaaagactcctggcacatgaggaagaaacccagaagaggagagcaaaggagtcaggaatggcttttactcagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaac

SEQ ID NO: 202423 - DNA, 2132 bp, Homo sapiens
  Payload ID: 19923
  Gene Name: zinc finger protein 415
  Uniprot ID: Q09FC8
  ENST ID: ENST00000601493
  CDS Start-End: 657-1634
tgaaggtgacggcgtcgagccattgacttccaaagactcctggcacatgaggaagaaacccagaagaggagagcaaaggagtcaggaatggcttttactcagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaataatttcttctaccatcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacatgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacgagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatatgttaaaactcacacaacatgatatatattaaaggttgcaggatgtttgaagtca

SEQ ID NO: 202424 - DNA, 504 bp, Homo sapiens
  Payload ID: 19923
  Gene Name: zinc finger protein 415
  ENST ID: ENST00000596051
  CDS Start-End: 435-504
aggcccggaaacggatcgcgttgggtgaaggtgacggcgtcgagcgtgtccaaaagtgacttcctgactccctagatgcattcccctgcagtcctgcacatctcagatgagcgggaccatgtatttcgtgggactttcaaatatataagattttacattgtgtgggagaaaaatgtttgacagcatctgccctgcctgatctgccctcccaggacctctctgacctcatctcctgcctgtgtcctcctcgctccctctgctccagccaagcatgcgtccttcctgttcctgggccgagcttgctcctgcctcaaggccttcacgtgggctgtgcctctgctggaactcgctggcccctcagctgcagcattgacttccaaagactcctggcacatgaggaagaaacccagaagaggagagcaaaggagtcaggaatggcttttactcagttgacattcagggacgtggccatcgaattctctcaagatgagtggaaatgcctga

SEQ ID NO: 202425 - DNA, 2561 bp, Homo sapiens
  Payload ID: 19924
  Gene Name: zinc finger protein 416
  Uniprot ID: Q9BWM5
  ENST ID: ENST00000196489
  CDS Start-End: 224-2008
ttgcatacggtaaggcgggacttccggcaccgctccgagatggtaattttggtggttctctacctcggcccacgccgcctgagttagaaacgctgcctccggcacagagcgggggtcgccccgctgcgcatcagccggtgggtcgctggcgctggtggcagccgtgcctgggttcccgccccgggtcgcccgccgctcccggccccgctccgctcacaatccgatggcggcggccgtgcttagggattcgacttcggttcccgtgactgcagaagctaaacttatgggctttacacagggctgtgtgacctttgaggacgtggccatttacttctcccaggaagaatgggggctccttgatgaggctcagaggctcctgtaccgcgatgtgatgctggagaactttgcacttataactgcgctggtttgttggcatgggatggaggatgaagagacacctgagcaaagtgtttctgtagaaggagtacctcaggtcaggactccagaggccagtccatccacccagaagattcaatcctgtgacatgtgtgtcccattcctgaccgacattttgcacctgaccgatttgcctgggcaggaactatacttgactggggcatgtgcggtctttcaccaggaccagaagcatcatagtgcagagaaacccttggaaagtgacatggacaaggcctcatttgtgcagtgctgcctgttccatgagtcaggaatgcctttcaccagcagtgaggttgggaaggacttcctagccccattgggcattcttcagccgcaagctattgctaactatgagaagccaaacaaaatcagcaaatgtgaggaggcctttcatgttggaataagtcattacaagtggagtcaatgcaggagagagtccagccacaaacacactttttttcaccctagagtctgcactggaaaaaggctttatgaatctagcaaatgtgggaaagcctgctgctgtgagtgctcccttgttcagctgcaaagagtccaccctggagaaaggccttatgagtgcagtgaatgtgggaaatcttttagccaaacctctcatctgaatgatcatcggagaatccacactggagaaaggccttatgtgtgtggtcagtgtgggaaatcatttagccaaagagccaccctcattaaacatcacagagttcacactggagaaaggccttacgagtgtggtgaatgtgggaaatcttttagccaaagttccaaccttattgaacattgcagaattcacactggagaaaggccttatgagtgtgatgaatgtggaaaagcctttgggtccaaatccactcttgttcgacaccagagaactcacacaggagaaaagccatatgagtgtggtgaatgtgggaaattattcagacaaagcttcagccttgttgtacaccagagaattcacactacagcaaggccttatgagtgtggccagtgtgggaaatcatttagcctaaagtgtggcctcattcagcaccagttaattcacagtggagctaggccctttgagtgtgatgagtgcggaaaatcctttagccaaagaaccaccctcaataaacaccacaaagttcacactgcagaaaggccttatgtatgtggggaatgtgggaaagcttttatgttcaaatctaaacttgttaggcaccagagaactcacactggagaaaggccttttgagtgcagtgaatgtgggaaattttttagacaaagctataccctcgttgaacaccagaaaattcacactggattaaggccttacgactgtggacagtgcgggaaatcctttatccaaaagtctagcctcattcaacaccaagtggttcacacaggagaaaggccatatgagtgtggcaaatgtgggaagtcctttacacaacactctggcctcattctccaccgaaaatctcacactgtggagaggcctcgtgacagcagcaaatgtggaaaaccctacagcccaagatctaacattgtttaactcttgaaactccaaacctgagaaaagccttagacctgcagggaatgtgccatgtctttcttcagtgttatggctatagagagcctttgtgaaggagccgtctgcctaaagttaaacctcatacttctagacctcccgatgggtcagactcccattagttccaggcatatgtgtcttgcaggagctcctttgcatgttctaaactgctggaggcctttgccagagttaaatcattagtcacccttgcatactaaggcgaggcagatacacctgtgttctcccaacccttggaggaaattccttgagcagtctgagcctttaaggggaattccttcccttttctgactgattacagcatacatctgaccagttttggccagaagggcccagcctgggttctgctggaagctgatgtggaaggcttcccttcatggaaattcttgttttcacacaacacttggtagtttttccagcctccaagtcaccacctagtaactggctgcctcacattgctctggtttgtgtggtaataaaggccttatttttaaatcta

SEQ ID NO: 202426 - DNA, 3597 bp, Homo sapiens
  Payload ID: 19925
  Gene Name: zinc finger protein 417
  Uniprot ID: Q8TAU3
  ENST ID: ENST00000312026
  CDS Start-End: 166-1893
cggtgacgcgggtgtttccccagtttgtggcccctgagtgctggggggggaccgcggtgactgaacctagaaggtggagaggaatcgtcctcggtgcccagaggcggctctgcagccccgtgacggcgaccactgctcccgggccgtgcttccccaagtagtccgatggcagcggctgcgccgaggcgcccgactcagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagcagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggaaagacagcttatccctgtgaggagtgcgggaaatcttttagtcagaagggcagccttattagccatcagcgtgttcacactggagaaaggccttatgagtgtagagaatatgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtggaaaatcttttggtcaaaagggcaacctcgttcaacatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctcgttcatgagagagttcacactggagaaaggccatatgcgtgtgaggtatgtgggaaattatttggtaataagaactgcgtgactatacatcagaggattcacactggagaaaggccgtatgaatgcaatgaatgtgggaaatcatttctttccagctctgcgcttcatgttcataaaagagttcattctggacaaaagccttataagtgcagtgaatgtggaaaatcctttgctgaatgttccagtctcattaaacacaggagaattcacactggagaaaggccttatgaatgtaccaaatgtggaaaaacatttcagcgaagctctaccctccttcatcatcagagttcacacaggagaaaggccttatgagtgcagtgaatatgggaaatcgtttgctgaaacatcccgtctcattaaacacaggagagttcatactggagaaaggccttatgagtgctgtcaatctgggaaacatcagaatgtctgctctccttggtcttaagagacttcgcattggaacggagtctcattctgtcacccaggctggagtgcagtggtgcaatcttggctcactgcaacttgggcctcccaggttcaagtgattctcctacctcagcctcccaaggagctgagattacgagtacaccacaccatgcccggccaaatacttggttttcagtaccacaagagctatgagctggttatccacttcatgtggaatcataagtgtccccaagtgacaatacgtatagattgctgggcagtgaaacagttaagatgtcaccgtagcttgctttctattcaacatctttctaagattaccttactatttcttttgttccaagtttgtatttcctcagagttctcacatatggaaaggatacacactttgtagaaacaagaactttatgttatccaagttctgggatagccatgagctccaattacctcagagctccgagtcctctactcagtacccgttgagatttatgtgttctgaggcttttgtcttctagctacttacttcattctccatgggtaacgtcattcatccacattaactaatttcctcactccaagctcttttctggagataatctccagtccctgtgcagacactgtcattgcactttctgctgaaatggtagtttcttgccagcaaggtgagattatggaatccagaatcttttttcaggggccacatgcccatttccccacttgcatgaatgtcgacactgtagccacagttttggccgtaaatgtgaatttggcaagtaaccactgttcccaaattgggaaatgtcccagtcagaagaagattatctgggacactgatactgacagggagatgggacattctgagggacccggaggcagggagccacctcctcagcttccctgagggctgcctagaatctctcttgtttcctctcactctgaattattcttcctctcatgactgaccaaacacatggaacctcacaaagtccattttaagagctttatcttgtgaagtgaagaacatgaagatagtttgaatcaaagttattgagtggacacttaatgtctttataacattttttacatatgtgtttgtgttttttggggagcataatttgcaaatggaatatctgttattttactaagatgcttcatggatacaagagttaaaacttcctgtcccatttagtgaaacaaaaggttaagaaatgtggataaagcttgtaagttagaaatggcaagataatcagctatatgaagaatctcagctgggtgttttggctcaggcctgtaatcccagcactttgggaggctgaggtgggtggcttacaaggtcaggagttcaagaccaccctggacaatatggtgaaaccctgtctctactaaaaatacaaaaattacccaagcatagtggtgggtgcctgtagtcccagctgcttgggaggctgaggcaggagaattcgttaaacctgggaggcataggttgcagtgagccgagattgcaccactgcactccagcctggtgacagagcgagactccgtctcaaaaaaaaaaaaaaaaaaaaaaaaaaa

SEQ ID NO: 202427 - DNA, 566 bp, Homo sapiens
  Payload ID: 19925
  Gene Name: zinc finger protein 417
  ENST ID: ENST00000599251
  CDS Start-End: 522-566
agacttccggggtctctagtagcggctgtgtatcggtgacgcgggtgtttccccagtttgtggcccctgagtgctggggggggaccgcggtgactgaacctagaaggtggagaggaatcgtcctcggtgcccagaggcggctctgcagccccgtgacggcgaccactgctcccgggccgtgcttccccaagtagtccgatggcagcggctgcgccgaggcgcccgactcagttataattttgcaaagacggtttcacctgtttctgacacccgtgggatgcggtggggagagcaacaagcacagggaggggcgcaggcaatggcctggagatggacggagccgggaggatggaacctgtctggaacaaagtgtgaggtggagctctccctggaagagtaagcaggccgagggctgtgcattcaagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgt

SEQ ID NO: 202428 - DNA, 583 bp, Homo sapiens
  Payload ID: 19925
  Gene Name: zinc finger protein 417
  ENST ID: ENST00000598526
  CDS Start-End: 430-583
gagacttccggggtctctagtagcggctgtgtatcggtgacgcgggtgtttccccagtttgtggcccctgagtgctggggggggaccgcggtgactgaacctagaaggtggagaggaatcgtcctcggtgcccagaggcggctctgcagccccgtgacggcgaccactgctcccgggccgtgcttccccaagtagtccgatggcagcggctgcgccgaggcgcccgactcagagtgaaaccatgaactgaattccttccctaagttaattcagcctatacccaggaatgaacaaggacagctgaaaggttggaagcaagacggagtcagtaagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtg

SEQ ID NO: 202429 - DNA, 550 bp, Homo sapiens
  Payload ID: 19925
  Gene Name: zinc finger protein 417
  ENST ID: ENST00000598629
  CDS Start-End: 487-550
tcggtgacgcgggtgtttccccagtttgtggcccctgagtgctggggggggaccgcggtgactgaacctagaaggtggagaggaatcgtcctcggtgcccagaggcggctctgcagccccgtgacggcgaccactgctcccgggccgtgcttccccaagtagtccgatggcagcggctgcgccgaggcgcccgactcagttataattttgcaaagacggtttcacctgtttctgacacccgtgggatgcggtggggagagcaacaagcacagggaggggcgcaggcaatggcctggagatggacggagccgggaggatggaacctgtctggaacaaagtgtgaggtggagctctccctggaagagtaagcaggccgagggctgtgcattcaagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggagg

SEQ ID NO: 202430 - DNA, 580 bp, Homo sapiens
  Payload ID: 19925
  Gene Name: zinc finger protein 417
  ENST ID: ENST00000597515
  CDS Start-End: 409-580
agtagcggctgtgtatcggtgacgcgggtgtttccccagtttgtggcccctgagtgctggggggggaccgcggtgactgaacctagaaggtggagaggaatcgtcctcggtgcccagaggcggctctgcagccccgtgacggcgaccactgctcccgggccgtgcttccccaagtagtccgatggcagcggctgcgccgaggcgcccgactcagagtgaaaccatgaactgaattccttccctaagttaattcagcctatacccaggaatgaacaaggacagctgaaaggttggaagcaagacggagtcagtaagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatct

SEQ ID NO: 202431 - DNA, 1975 bp, Homo sapiens
  Payload ID: 19925
  Gene Name: zinc finger protein 417
  ENST ID: ENST00000595559
  CDS Start-End: 181-1905
gtagcggctgtgtatcggtgacgcgggtgtttccccagtttgtggcccctgagtgctggggggggaccgcggtgactgaacctagaaggtggagaggaatcgtcctcggtgcccagaggcggctctgcagccccgtgacggcgaccactgctcccgggccgtgcttccccaagtagtccgatggcagcggctgcgccgaggcgcccgactcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagcagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggaaagacagcttatccctgtgaggagtgcgggaaatcttttagtcagaagggcagccttattagccatcagcgtgttcacactggagaaaggccttatgagtgtagagaatatgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtggaaaatcttttggtcaaaagggcaacctcgttcaacatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctcgttcatgagagagttcacactggagaaaggccatatgcgtgtgaggtatgtgggaaattatttggtaataagaactgcgtgactatacatcagaggattcacactggagaaaggccgtatgaatgcaatgaatgtgggaaatcatttctttccagctctgcgcttcatgttcataaaagagttcattctggacaaaagccttataagtgcagtgaatgtggaaaatcctttgctgaatgttccagtctcattaaacacaggagaattcacactggagaaaggccttatgaatgtaccaaatgtggaaaaacatttcagcgaagctctaccctccttcatcatcagagttcacacaggagaaaggccttatgagtgcagtgaatatgggaaatcgtttgctgaaacatcccgtctcattaaacacaggagagttcatactgga

SEQ ID NO: 202432 - DNA, 386 bp, Homo sapiens
  Payload ID: 19925
  Gene Name: zinc finger protein 417
  ENST ID: ENST00000594396
  CDS Start-End: 1-272
atgtggctgtgaacttttcccaggaggagtggtgtcttcttagtgaggctcagaggtgcttgtaccgtgatgtgatgctagagaacctggctctcatatcctcgctggattgtcctctgcatctgtgccagtttcctgatttgtccccatgttggagggtctgcctggataagccgtatctttttctgaggcctgcagcattaagatgggttaaggaatggaacgtttgtgcatcggcaaaagctgcagaaaccagtgcatccgccctttgattaagttaaaaggaccagggaggttagtatgtgctctcatatgagtaatatagaaaggggaatgtctttgttgtactgcttgttgtaaagaatgaaataaaagattaagttgtt

SEQ ID NO: 202433 - DNA, 3694 bp, Homo sapiens
  Payload ID: 19926
  Gene Name: zinc finger protein 418
  Uniprot ID: Q8TF45
  ENST ID: ENST00000396147
  CDS Start-End: 293-2323
ttttggttaatgttgggtgtgtttctgcggtttgtgaggtgagaggcgctggagctatgggtccgaaccgcggtgtctgaacccagaaggtgaagagtccttcttgctgcacagaggcagatcttaggccccgtaacggcgcccgccgctcccggcagtgctttccccgcgtactcgggatggcggcggccgcgctgaggctcccggctcaggcatcatctggctgcaaagaagagaacacactgtgtttgagggaggaggaaggaggatcagagtttaaactcctgccataatgcagggcactgtggcatttgaagatgtggctgtgaacttttcccaggaggagtggagtctccttagtgaggttcagagatgcctttaccatgacgtgatgctggagaactgggtacttatatcctccctgggttgttggtgtggatcagaagatgaggaggcaccttctaagaagagcatttctatacaaagagtgtctcaggtcagcactcctggggcaggtgtgtctcccaagaaggcccactcttgtgaaatgtgtggcgcgatcttgggagacattttgcacttggcagatcatcaggggacacatcacaagcagaaactgcacaggtgtgaggcatgggggaataaattgtatgatagttcaaaccgtccgcaccagaatcagtaccttggagagaaaccctatagaagcagtgttgaggaagcattgtttgtgaagaggtgtaagttccatgtgtcagaggagtcatctatcttcattcagagtggaaaggactttttgcccagctcaggattactgctgcaggaggccactcacactggggagaagtcaaacagcaaacctgagtgtgagtctccctttcagtggggagatactcattacagctgtggagaatgcatgaaacattctagcaccaaacacgtatttgttcaacagcagagacttccctctagagaggaatgttattgctgggaatgtgggaaatcctttagcaaatatgatagcgtcagtaatcatcagagagttcacactgggaaaagaccttatgaatgtggagaatgtgggaaatcttttagtcataagggcagccttgttcagcatcagcgagttcacactgggaaaagaccttatgaatgtggagaatgtgggaaatcttttagtcataagggcagccttgttcagcatcagcgagttcatactggagaaagaccttatgagtgtggagaatgtgggaaatcttttagtcaaaatggtactctcattaaacatcaacgagttcacactggagaaagaccttatgagtgtgaagaatgtgggaaatgttttactcagaagggcaatctcattcaacatcaacgaggtcacactagtgaaagaccttatgagtgtgaagaatgtggaaaatgttttagtcaaaagggcaccctaactgaacatcatcgagttcacactagagaacgaccttatgagtgtggagaatgtgggaaatcttttagtcgaaagggacaccttaggaaccatcagcgaggtcacactggagaaagaccttacgagtgtggagaatgtgggaaatcttttagtcgaaagggcaacctcattcagcatcagcgaagccacactggagaaaggccttatgagtgtagagagtgtaggaaattatttaggggcaagtcccacctcattgaacaccagagagttcacactggagaaaggccatatgaatgtaatgaatgtgggaaatcatttcaagacagctctgggtttcgtgttcatcagagagttcacactggagaaaaaccgtttgagtgtagtgaatgtgggaagtcatttcctcaaagctgttccctccttcgacatcggagagttcatactggagaaaggccttatgaatgtggagaatgtggaaagtcatttcatcagagctcttccctccttcgacatcagaaaactcacactgcagaaagaccttatgagtgcagagaatgtgggaaattcttctccagtctccttgaacacaggagagttcacactggagaaaggccttatgaatgcagggaatgtggaaaaacatttactcgaaggtctgcgcattttaaacatcagagacttcatactcgaggaaagccttacgagtgcagcgaatgtgggaaatcctttgctgaaaccttcagtcttactgaacacaggagagtacacactggagaaaggccttatgagtgcagtgaatgtggaaaatcatttcatcgaagctcttctctccttcgacatcagagagttcacacagaaagaagtccttacaagtgaaaagaaatttgggaaattctttagctaaacctctgtgcatcttcttgatcagagggttcttactggatcaggaccttatgagtgtgacaaacgtgggatattctttatgcagaagtcttgttttattacatacagaagagctcccactgcagaagggcctcttgagtgcgatgaatgtgagaaagccttctgccttctgtcattggataacagattgttctcataaggaaaacactgtacacgtacaggaaatattatttcttgtaaaacataacactggaggagatgccttatgacggagccatctgcctaaattgacataccttcagcatctgcataaactcaattatgttggagctgtgtggcatttttcaccctgccgggttcccttgccagacatgatgtcggttatctggcaaaagccattttatgtcggccacgaggcaggtgttcactgtgcatcattcattcaccccatgatgttctggaagtaaaccttggttgtctttcgttggccagaggaattgaatgtccgtctgtctgcccaggctggagtggcacgatctcagctcactgcagcctccacctccagggttcaagcgattctcctgcctcagcctcccggggatctcaagggcatttccctttgcccacctcaccttttcatatttggtaaactgtatgcatttgcctccagcccaagattataaatatgaactgattatgatctgcatgttctctctttgggttcaagcatttccttacagaagagccaccgtggaagtcatgggtaaatatgtgttgaattggtaactccctcttggagaatttcttgtgaattacacagcaataggggaactcatttaactggagacataatctcaatttgtaaagtgtggcccattttctaacatttttattttgcataccctcccctctcttctcgattgatgaaactaacaaagaggttaataaaagcccatctcgtcatgtacagggactcatgcctttaattccagtgttttgggagactaaggcaagaacatcctggaggccaggagttcgacactgtataacagatatatctgacagcagtaactcaagcacaccctaagaatgaccctgtggtctaagaagagtgttggttcagcgttccaaacgaagaaatccaggagtggccaacctggaggtttctgaacccctggcctgttccttggaatgaggccctttgttttgagctaggcggagggtgataagtgaaaatactatataaactgcatgcttctttcaaatgatagtggtttttttgtccagcctgccgctcctggactgccctgtatctaagtcctcaataaaccctatgtctcattt

SEQ ID NO: 202434 - DNA, 3547 bp, Homo sapiens
  Payload ID: 19926
  Gene Name: zinc finger protein 418
  ENST ID: ENST00000425570
  CDS Start-End: 465-2558
ctctggtagcgaccattttggttaatgttgggtgtgtttctgcggtttgtgaggtgagaggcgctggagctatgggtccgaaccgcggtgtctgaacccagaaggtgaagagtccttcttgctgcacagaggcagatcttaggccccgtaacggcgcccgccgctcccggcagtgctttccccgcgtactcgggatggcggcggccgcgctgaggctcccggctcaggcatcatctggctgcaaagaagagaacacactgtgtttgagggaggaggaaggaggatcagagtttaaactcctgccataatgcagaccattctccataacaagggagtgggatttaaatgactctaggtggacagaggaaagtcgtcattgtagaggggtcaccaagtgcaacacagaagtggaatagggccatggatatctaaagccccacctggttctgtggggatgtggagccatgcaagaaggccttcatagaatgacttgggactgcattgctattgggagccatgagaattctgtgcagggcactgtggcatttgaagatgtggctgtgaacttttcccaggaggagtggagtctccttagtgaggttcagagatgcctttaccatgacgtgatgctggagaactgggtacttatatcctccctgggttgttggtgtggatcagaagatgaggaggcaccttctaagaagagcatttctatacaaagagtgtctcaggtcagcactcctggggcaggtgtgtctcccaagaaggcccactcttgtgaaatgtgtggcgcgatcttgggagacattttgcacttggcagatcatcaggggacacatcacaagcagaaactgcacaggtgtgaggcatgggggaataaattgtatgatagttcaaaccgtccgcaccagaatcagtaccttggagagaaaccctatagaagcagtgttgaggaagcattgtttgtgaagaggtgtaagttccatgtgtcagaggagtcatctatcttcattcagagtggaaaggactttttgcccagctcaggattactgctgcaggaggccactcacactggggagaagtcaaacagcaaacctgagtgtgagtctccctttcagtggggagatactcattacagctgtggagaatgcatgaaacattctagcaccaaacacgtatttgttcaacagcagagacttccctctagagaggaatgttattgctgggaatgtgggaaatcctttagcaaatatgatagcgtcagtaatcatcagagagttcacactgggaaaagaccttatgaatgtggagaatgtgggaaatcttttagtcataagggcagccttgttcagcatcagcgagttcacactgggaaaagaccttatgaatgtggagaatgtgggaaatcttttagtcataagggcagccttgttcagcatcagcgagttcatactggagaaagaccttatgagtgtggagaatgtgggaaatcttttagtcaaaatggtactctcattaaacatcaacgagttcacactggagaaagaccttatgagtgtgaagaatgtgggaaatgttttactcagaagggcaatctcattcaacatcaacgaggtcacactagtgaaagaccttatgagtgtgaagaatgtggaaaatgttttagtcaaaagggcaccctaactgaacatcatcgagttcacactagagaacgaccttatgagtgtggagaatgtgggaaatcttttagtcgaaagggacaccttaggaaccatcagcgaggtcacactggagaaagaccttacgagtgtggagaatgtgggaaatcttttagtcgaaagggcaacctcattcagcatcagcgaagccacactggagaaaggccttatgagtgtagagagtgtaggaaattatttaggggcaagtcccacctcattgaacaccagagagttcacactggagaaaggccatatgaatgtaatgaatgtgggaaatcatttcaagacagctctgggtttcgtgttcatcagagagttcacactggagaaaaaccgtttgagtgtagtgaatgtgggaagtcatttcctcaaagctgttccctccttcgacatcggagagttcatactggagaaaggccttatgaatgtggagaatgtggaaagtcatttcatcagagctcttccctccttcgacatcagaaaactcacactgcagaaagaccttatgagtgcagagaatgtgggaaattcttctccagtctccttgaacacaggagagttcacactggagaaaggccttatgaatgcagggaatgtggaaaaacatttactcgaaggtctgcgcattttaaacatcagagacttcatactcgaggaaagccttacgagtgcagcgaatgtgggaaatcctttgctgaaaccttcagtcttactgaacacaggagagtacacactggagaaaggccttatgagtgcagtgaatgtggaaaatcatttcatcgaagctcttctctccttcgacatcagagagttcacacagaaagaagtccttacaagtgaaaagaaatttgggaaattctttagctaaacctctgtgcatcttcttgatcagagggttcttactggatcaggaccttatgagtgtgacaaacgtgggatattctttatgcagaagtcttgttttattacatacagaagagctcccactgcagaagggcctcttgagtgcgatgaatgtgagaaagccttctgccttctgtcattggataacagattgttctcataaggaaaacactgtacacgtacaggaaatattatttcttgtaaaacataacactggaggagatgccttatgacggagccatctgcctaaattgacataccttcagcatctgcataaactcaattatgttggagctgtgtggcatttttcaccctgccgggttcccttgccagacatgatgtcggttatctggcaaaagccattttatgtcggccacgaggcaggtgttcactgtgcatcattcattcaccccatgatgttctggaagtaaaccttggttgtctttcgttggccagaggaattgaatgtccgtctgtctgcccaggctggagtggcacgatctcagctcactgcagcctccacctccagggttcaagcgattctcctgcctcagcctcccggggatctcaagggcatttccctttgcccacctcaccttttcatatttggtaaactgtatgcatttgcctccagcccaagattataaatatgaactgattatgatctgcatgttctctctttgggttcaagcatttccttacagaagagccaccgtggaagtcatgggtaaatatgtgttgaattggtaactccctcttggagaatttcttgtgaattacacagcaataggggaactcatttaactggagacataatctcaatttgtaaagtgtggcccattttctaacatttttattttgcataccctcccctctcttctcgattgatgaaactaacaaagaggttaataaaagcccatctcgtc

SEQ ID NO: 202435 - DNA, 560 bp, Homo sapiens
  Payload ID: 19926
  Gene Name: zinc finger protein 418
  ENST ID: ENST00000595569
  CDS Start-End: 340-560
agcgaccattttggttaatgttgggtgtgtttctgcggtttgtgaggtcacctcatcctaacccgaatcctgaagcagcgagagagcggcgactgttcacaggcatcatctggctgcaaagaagagaacacactgtgtttgagggaggaggaaggaggatcagagtttaaactcctgccataatgcagaccattctccataacaagggagtgggatttaaatgactctaggtggacagaggaaagtcgtcattgtagaggggtcaccaagtgcaacacagaagtggaatagggccatggatatctaaagccccacctggttctgtggggatgtggagccatgcaagaaggccttcatagaatgacttgggactgcattgctattgggagccatgagaattctgtggaggagtggagtctccttagtgaggttcagagatgcctttaccatgacgtgatgctggagaactgggtacttatatcctccctgggttgttggtgtggatcagaagatgaggaggcaccttctaagaagagcatttctatacaaagagtgtctca

SEQ ID NO: 202436 - DNA, 2501 bp, Homo sapiens
  Payload ID: 19926
  Gene Name: zinc finger protein 418
  ENST ID: ENST00000599852
  CDS Start-End: 346-2121
ggtagcgaccattttggttaatgttgggtgtgtttctgcggtttgtgaggtgagaggcgctggagctatgggtccgaaccgcggtgtctgaacccagaaggtgaagagtccttcttgctgcacagaggcagatcttaggccccgtaacggcgcccgccgctcccggcagtgctttccccgcgtactcgggatggcggcggccgcgctgaggctcccggctcaggttgttggtgtggatcagaagatgaggaggcaccttctaagaagagcatttctatacaaagagtgtctcaggtcagcactcctggggcaggtgtgtctcccaagaaggcccactcttgtgaaatgtgtggcgcgatcttgggagacattttgcacttggcagatcatcaggggacacatcacaagcagaaactgcacaggtgtgaggcatgggggaataaattgtatgatagttcaaaccgtccgcaccagaatcagtaccttggagagaaaccctatagaagcagtgttgaggaagcattgtttgtgaagaggtgtaagttccatgtgtcagaggagtcatctatcttcattcagagtggaaaggactttttgcccagctcaggattactgctgcaggaggccactcacactggggagaagtcaaacagcaaacctgagtgtgagtctccctttcagtggggagatactcattacagctgtggagaatgcatgaaacattctagcaccaaacacgtatttgttcaacagcagagacttccctctagagaggaatgttattgctgggaatgtgggaaatcctttagcaaatatgatagcgtcagtaatcatcagagagttcacactgggaaaagaccttatgaatgtggagaatgtgggaaatcttttagtcataagggcagccttgttcagcatcagcgagttcacactgggaaaagaccttatgaatgtggagaatgtgggaaatcttttagtcataagggcagccttgttcagcatcagcgagttcatactggagaaagaccttatgagtgtggagaatgtgggaaatcttttagtcaaaatggtactctcattaaacatcaacgagttcacactggagaaagaccttatgagtgtgaagaatgtgggaaatgttttactcagaagggcaatctcattcaacatcaacgaggtcacactagtgaaagaccttatgagtgtgaagaatgtggaaaatgttttagtcaaaagggcaccctaactgaacatcatcgagttcacactagagaacgaccttatgagtgtggagaatgtgggaaatcttttagtcgaaagggacaccttaggaaccatcagcgaggtcacactggagaaagaccttacgagtgtggagaatgtgggaaatcttttagtcgaaagggcaacctcattcagcatcagcgaagccacactggagaaaggccttatgagtgtagagagtgtaggaaattatttaggggcaagtcccacctcattgaacaccagagagttcacactggagaaaggccatatgaatgtaatgaatgtgggaaatcatttcaagacagctctgggtttcgtgttcatcagagagttcacactggagaaaaaccgtttgagtgtagtgaatgtgggaagtcatttcctcaaagctgttccctccttcgacatcggagagttcatactggagaaaggccttatgaatgtggagaatgtggaaagtcatttcatcagagctcttccctccttcgacatcagaaaactcacactgcagaaagaccttatgagtgcagagaatgtgggaaattcttctccagtctccttgaacacaggagagttcacactggagaaaggccttatgaatgcagggaatgtggaaaaacatttactcgaaggtctgcgcattttaaacatcagagacttcatactcgaggaaagccttacgagtgcagcgaatgtgggaaatcctttgctgaaaccttcagtcttactgaacacaggagagtacacactggagaaaggccttatgagtgcagtgaatgtggaaaatcatttcatcgaagctcttctctccttcgacatcagagagttcacacagaaagaagtccttacaagtgaaaagaaatttgggaaattctttagctaaacctctgtgcatcttcttgatcagagggttcttactggatcaggaccttatgagtgtgacaaacgtgggatattctttatgcagaagtcttgttttattacatacagaagagctcccactgcagaagggcctcttgagtgcgatgaatgtgagaaagccttctgccttctgtcattggataacagattgttctcataaggaaaacactgtacacgtacaggaaatattatttcttgtaaaacataacactggaggagatgccttatgacggagccatctgcctaaattgacataccttcagcatctgcataaactcaattatgttggagctgtgtggcatttttcaccctgc

SEQ ID NO: 202437 - DNA, 540 bp, Homo sapiens
  Payload ID: 19926
  Gene Name: zinc finger protein 418
  ENST ID: ENST00000601593
  CDS Start-End: 245-540
agcgttctctggtagcgaccattttggttaatgttgggtgtgtttctgcggtttgtgaggtcacctcatcctaacccgaatcctgaagcagcgagagagcggcgactgttcacaggtctgcagcccggacccggcgtcgggacactgaggcgttcgcgggagaggcatcatctggctgcaaagaagagaacacactgtgtttgagggaggaggaaggaggatcagagtttaaactcctgccataatgcagcagggcactgtggcatttgaagatgtggctgtgaacttttcccaggaggagtggagtctccttagtgaggttcagagatgcctttaccatgacgtgatgctggagaactgggtacttatatcctccctgggttgttggtgtggatcagaagatgaggaggcaccttctaagaagagcatttctatacaaagagtgtctcaggtcagcactcctggggcaggtgtgtctcccaagaaggcccactcttgtgaaatgtgtggcgcgatcttgggagacattttgcacttggc

SEQ ID NO: 202438 - DNA, 597 bp, Homo sapiens
  Payload ID: 19926
  Gene Name: zinc finger protein 418
  ENST ID: ENST00000600989
  CDS Start-End: 97-483
gaggctcccggctcaggcatcatctggctgcaaagaagagaacacactgtgtttgagggaggaggaaggaggatcagagtttaaactcctgccataatgcagggcactgtggcatttgaagatgtggctgtgaacttttcccaggaggagtggagtctccttagtgaggttcagagatgcctttaccatgacgtgatgctggagaactgggtacttatatcctccctgggttgttggtgtggatcagaagatgaggaggcaccttctaagaagagcatttctatacaaagagtgtctcagaatgtccgtctgtctgcccaggctggagtggcacgatctcagctcactgcagcctccacctccagggttcaagcgattctcctgcctcagcctcccggggatctcaagggcatttccctttgcccacctcaccttttcatatttggtaaactgtatgcatttgcctccagcccaagattataaatatgaactgattatgatctgcatgttctctctttgggttcaagcatttccttacagaagagccaccgtggaagtcatgggtaaatatgtgttgaattggtaactccctcttgg

SEQ ID NO: 202439 - DNA, 3543 bp, Homo sapiens
  Payload ID: 19926
  Gene Name: zinc finger protein 418
  Uniprot ID: Q8TF45
  ENST ID: ENST00000595830
  CDS Start-End: 142-2172
tcggtggggaggcaagagggcggcgaggaggtgatgttaccacagtcccatttgtctgcaggcatcatctggctgcaaagaagagaacacactgtgtttgagggaggaggaaggaggatcagagtttaaactcctgccataatgcagggcactgtggcatttgaagatgtggctgtgaacttttcccaggaggagtggagtctccttagtgaggttcagagatgcctttaccatgacgtgatgctggagaactgggtacttatatcctccctgggttgttggtgtggatcagaagatgaggaggcaccttctaagaagagcatttctatacaaagagtgtctcaggtcagcactcctggggcaggtgtgtctcccaagaaggcccactcttgtgaaatgtgtggcgcgatcttgggagacattttgcacttggcagatcatcaggggacacatcacaagcagaaactgcacaggtgtgaggcatgggggaataaattgtatgatagttcaaaccgtccgcaccagaatcagtaccttggagagaaaccctatagaagcagtgttgaggaagcattgtttgtgaagaggtgtaagttccatgtgtcagaggagtcatctatcttcattcagagtggaaaggactttttgcccagctcaggattactgctgcaggaggccactcacactggggagaagtcaaacagcaaacctgagtgtgagtctccctttcagtggggagatactcattacagctgtggagaatgcatgaaacattctagcaccaaacacgtatttgttcaacagcagagacttccctctagagaggaatgttattgctgggaatgtgggaaatcctttagcaaatatgatagcgtcagtaatcatcagagagttcacactgggaaaagaccttatgaatgtggagaatgtgggaaatcttttagtcataagggcagccttgttcagcatcagcgagttcacactgggaaaagaccttatgaatgtggagaatgtgggaaatcttttagtcataagggcagccttgttcagcatcagcgagttcatactggagaaagaccttatgagtgtggagaatgtgggaaatcttttagtcaaaatggtactctcattaaacatcaacgagttcacactggagaaagaccttatgagtgtgaagaatgtgggaaatgttttactcagaagggcaatctcattcaacatcaacgaggtcacactagtgaaagaccttatgagtgtgaagaatgtggaaaatgttttagtcaaaagggcaccctaactgaacatcatcgagttcacactagagaacgaccttatgagtgtggagaatgtgggaaatcttttagtcgaaagggacaccttaggaaccatcagcgaggtcacactggagaaagaccttacgagtgtggagaatgtgggaaatcttttagtcgaaagggcaacctcattcagcatcagcgaagccacactggagaaaggccttatgagtgtagagagtgtaggaaattatttaggggcaagtcccacctcattgaacaccagagagttcacactggagaaaggccatatgaatgtaatgaatgtgggaaatcatttcaagacagctctgggtttcgtgttcatcagagagttcacactggagaaaaaccgtttgagtgtagtgaatgtgggaagtcatttcctcaaagctgttccctccttcgacatcggagagttcatactggagaaaggccttatgaatgtggagaatgtggaaagtcatttcatcagagctcttccctccttcgacatcagaaaactcacactgcagaaagaccttatgagtgcagagaatgtgggaaattcttctccagtctccttgaacacaggagagttcacactggagaaaggccttatgaatgcagggaatgtggaaaaacatttactcgaaggtctgcgcattttaaacatcagagacttcatactcgaggaaagccttacgagtgcagcgaatgtgggaaatcctttgctgaaaccttcagtcttactgaacacaggagagtacacactggagaaaggccttatgagtgcagtgaatgtggaaaatcatttcatcgaagctcttctctccttcgacatcagagagttcacacagaaagaagtccttacaagtgaaaagaaatttgggaaattctttagctaaacctctgtgcatcttcttgatcagagggttcttactggatcaggaccttatgagtgtgacaaacgtgggatattctttatgcagaagtcttgttttattacatacagaagagctcccactgcagaagggcctcttgagtgcgatgaatgtgagaaagccttctgccttctgtcattggataacagattgttctcataaggaaaacactgtacacgtacaggaaatattatttcttgtaaaacataacactggaggagatgccttatgacggagccatctgcctaaattgacataccttcagcatctgcataaactcaattatgttggagctgtgtggcatttttcaccctgccgggttcccttgccagacatgatgtcggttatctggcaaaagccattttatgtcggccacgaggcaggtgttcactgtgcatcattcattcaccccatgatgttctggaagtaaaccttggttgtctttcgttggccagaggaattgaatgtccgtctgtctgcccaggctggagtggcacgatctcagctcactgcagcctccacctccagggttcaagcgattctcctgcctcagcctcccggggatctcaagggcatttccctttgcccacctcaccttttcatatttggtaaactgtatgcatttgcctccagcccaagattataaatatgaactgattatgatctgcatgttctctctttgggttcaagcatttccttacagaagagccaccgtggaagtcatgggtaaatatgtgttgaattggtaactccctcttggagaatttcttgtgaattacacagcaataggggaactcatttaactggagacataatctcaatttgtaaagtgtggcccattttctaacatttttattttgcataccctcccctctcttctcgattgatgaaactaacaaagaggttaataaaagcccatctcgtcatgtacagggactcatgcctttaattccagtgttttgggagactaaggcaagaacatcctggaggccaggagttcgacactgtataacagatatatctgacagcagtaactcaagcacaccctaagaatgaccctgtggtctaagaagagtgttggttcagcgttccaaacgaagaaatccaggagtggccaacctggaggtttctgaacccctggcctgttccttggaatgaggccctttgttttgagctaggcggagggtgataagtgaaaatactatataaactgcatgcttctttcaaatgatagtggtttttttgtccagcctgccgctcctggactgccctgtatctaagtcctcaataaaccctatgtctcattt

SEQ ID NO: 202440 - DNA, 543 bp, Homo sapiens
  Payload ID: 19926
  Gene Name: zinc finger protein 418
  ENST ID: ENST00000593296
  CDS Start-End: 265-543
aaggaacccacagagggaattagagggtgttccattccctcactggccttattccccattcacatgttctctagcttgtgatgtcctgggactcttacttgccattttttcagtcctttgatctgagaacactggagaaaccctaaacccagaatcctaagtccatgacacaggatgtatggaggcatcatctggctgcaaagaagagaacacactgtgtttgagggaggaggaaggaggatcagagtttaaactcctgccataatgcagcagggcactgtggcatttgaagatgtggctgtgaacttttcccaggaggagtggagtctccttagtgaggttcagagatgcctttaccatgacgtgatgctggagaactgggtacttatatcctccctgggttgttggtgtggatcagaagatgaggaggcaccttctaagaagagcatttctatacaaagagtgtctcaggtcagcactcctggggcaggtgtgtctcccaagaaggcccactcttgtgaaatgtgtggcgcgatcttggga

SEQ ID NO: 202441 - DNA, 2212 bp, Homo sapiens
  Payload ID: 19926
  Gene Name: zinc finger protein 418
  Uniprot ID: Q8TF45
  ENST ID: ENST00000616958
  CDS Start-End: 84-2114
caggcatcatctggctgcaaagaagagaacacactgtgtttgagggaggaggaaggaggatcagagtttaaactcctgccataatgcagggcactgtggcatttgaagatgtggctgtgaacttttcccaggaggagtggagtctccttagtgaggttcagagatgcctttaccatgacgtgatgctggagaactgggtacttatatcctccctgggttgttggtgtggatcagaagatgaggaggcaccttctaagaagagcatttctatacaaagagtgtctcaggtcagcactcctggggcaggtgtgtctcccaagaaggcccactcttgtgaaatgtgtggcgcgatcttgggagacattttgcacttggcagatcatcaggggacacatcacaagcagaaactgcacaggtgtgaggcatgggggaataaattgtatgatagttcaaaccgtccgcaccagaatcagtaccttggagagaaaccctatagaagcagtgttgaggaagcattgtttgtgaagaggtgtaagttccatgtgtcagaggagtcatctatcttcattcagagtggaaaggactttttgcccagctcaggattactgctgcaggaggccactcacactggggagaagtcaaacagcaaacctgagtgtgagtctccctttcagtggggagatactcattacagctgtggagaatgcatgaaacattctagcaccaaacacgtatttgttcaacagcagagacttccctctagagaggaatgttattgctgggaatgtgggaaatcctttagcaaatatgatagcgtcagtaatcatcagagagttcacactgggaaaagaccttatgaatgtggagaatgtgggaaatcttttagtcataagggcagccttgttcagcatcagcgagttcacactgggaaaagaccttatgaatgtggagaatgtgggaaatcttttagtcataagggcagccttgttcagcatcagcgagttcatactggagaaagaccttatgagtgtggagaatgtgggaaatcttttagtcaaaatggtactctcattaaacatcaacgagttcacactggagaaagaccttatgagtgtgaagaatgtgggaaatgttttactcagaagggcaatctcattcaacatcaacgaggtcacactagtgaaagaccttatgagtgtgaagaatgtggaaaatgttttagtcaaaagggcaccctaactgaacatcatcgagttcacactagagaacgaccttatgagtgtggagaatgtgggaaatcttttagtcgaaagggacaccttaggaaccatcagcgaggtcacactggagaaagaccttacgagtgtggagaatgtgggaaatcttttagtcgaaagggcaacctcattcagcatcagcgaagccacactggagaaaggccttatgagtgtagagagtgtaggaaattatttaggggcaagtcccacctcattgaacaccagagagttcacactggagaaaggccatatgaatgtaatgaatgtgggaaatcatttcaagacagctctgggtttcgtgttcatcagagagttcacactggagaaaaaccgtttgagtgtagtgaatgtgggaagtcatttcctcaaagctgttccctccttcgacatcggagagttcatactggagaaaggccttatgaatgtggagaatgtggaaagtcatttcatcagagctcttccctccttcgacatcagaaaactcacactgcagaaagaccttatgagtgcagagaatgtgggaaattcttctccagtctccttgaacacaggagagttcacactggagaaaggccttatgaatgcagggaatgtggaaaaacatttactcgaaggtctgcgcattttaaacatcagagacttcatactcgaggaaagccttacgagtgcagcgaatgtgggaaatcctttgctgaaaccttcagtcttactgaacacaggagagtacacactggagaaaggccttatgagtgcagtgaatgtggaaaatcatttcatcgaagctcttctctccttcgacatcagagagttcacacagaaagaagtccttacaagtgaaaagaaatttgggaaattctttagctaaacctctgtgcatcttcttgatcagagggttcttactggatcaggaccttatgagtgtgacaaacgtggga

SEQ ID NO: 202442 - DNA, 2309 bp, Homo sapiens
  Payload ID: 19927
  Gene Name: zinc finger protein 419
  Uniprot ID: Q96HQ0
  ENST ID: ENST00000221735
  CDS Start-End: 187-1719
gactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggttcctgtggctgcagacttgcttacagaccatgaggagggctatgtgacctttgaggatgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttacactggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccatacacccttatgaccatt

SEQ ID NO: 202443 - DNA, 3654 bp, Homo sapiens
  Payload ID: 19927
  Gene Name: zinc finger protein 419
  Uniprot ID: Q96HQ0
  ENST ID: ENST00000347466
  CDS Start-End: 211-1647
gtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggttcctgtggctgcagacttgcttacagaccatgaggagcagggctatgtgacctttgaggatgtggctgtctacttctcccaggaggaatggagattgcttgatgacgctcagaggctcctctaccgcaatgtgatgctggagaactttacacttctggcctctctgggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttacactggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccatacacccttatgaccatttccagagactgaattgtgtttttataattttcacccttttggctgtgtaacaggtctgcaaagctcctcattcagttattctgtaagttgatccaaatgtttcaaattttaagaacttgccaaattgtgttctaaatggttagcatttcatatttcctcctggaatatattagattttccatttcttcacattactgacagtttatatgtgtagaagtcataggccattcattttagccatgttactaagtgtgaagtagtatttcattgtagttcttaatttgtatttttccgatgactcagttttgagcattttttaatgtgtttacttgtcacccatatatcttctttagtcaaatgtattttttgcctgttttttaaaacatttggttggttacaagttcttaatatttctggagacaaattccttatttgatataagcattgtcaatattttctcatggtccatggcttttgttttcttttcttttttaaaatttagagatgaggtcgtgctatgttgcacagactagtctctaactcctggcctcaagtgatcatcctgcctcagcctcccaaagtgctgggattacaggcatgagccaccatgcttggccttgttttcagttcttaacagtatctttcctagagcagattgtcttaattttatggagcccaatttatccatttgttattttattcattgtgcatttggtgttgcatcctcttactataccatatctttgcctataaataaaagccttgactgagtgcggtggctcacgcctgtaatcccaacactttgggaggccaaggcgggtggatcacgaggtcaggagattgagaccatcctggctaacacagtgaaactccctctcaactaaaaatacaaaaaattagctgggcgtggtggcggctgcctgtagttccagctatcctggaggctgaggcaggagaatggtgtgagcccgggaggcggagcttgcagtgagccgagattgcgccactgcactccagcctggggcacaaagccagactctgtctcaaaaaaaaaaaaaaaaaaaaaaaaaaaaaaaaaaaaaaaaaaaagccttatgtgagtatgctactgtaatcttatgaatctttttaaatatccaacttctgaaatatttgtaggtttaactacaaataaataattcaatatatagataaatgtgtacatattccctatctttactgagagcctagcaagccatggcattccagtagttttgagcacatttaatacccagttattggtttatatcattttttaataaaaggaaccagaactccttagagaagaggctgttttcaagttgtggcagaaaaggtacaacatgatttgaggaaatactgcattggaaaataaataaatgttcacagaataatgttg

SEQ ID NO: 202444 - DNA, 1569 bp, Homo sapiens
  Payload ID: 19927
  Gene Name: zinc finger protein 419
  ENST ID: ENST00000354197
  CDS Start-End: 241-1569
gtgcgacacgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagcagggctatgtgacctttgaggatgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccagccttgttaaacatcagagggttcacactggagcaaagccttatgagtgcagggaatgtgggaagttttttcgccacaactccagtctttttaaacatcgaaggattcacactggagaaatgcagtga

SEQ ID NO: 202445 - DNA, 2323 bp, Homo sapiens
  Payload ID: 19927
  Gene Name: zinc finger protein 419
  Uniprot ID: Q96HQ0
  ENST ID: ENST00000424930
  CDS Start-End: 230-1765
aatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggttcctgtggctgcagacttgcttacagaccatgaggagcagggctatgtgacctttgaggatgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttacactggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataa

SEQ ID NO: 202446 - DNA, 2319 bp, Homo sapiens
  Payload ID: 19927
  Gene Name: zinc finger protein 419
  Uniprot ID: Q96HQ0
  ENST ID: ENST00000426954
  CDS Start-End: 241-1737
gtgcgacacgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagcagggctatgtgacctttgaggatgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttacactggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccatacaccctta

SEQ ID NO: 202447 - DNA, 2186 bp, Homo sapiens
  Payload ID: 19927
  Gene Name: zinc finger protein 419
  Uniprot ID: Q96HQ0
  ENST ID: ENST00000415379
  CDS Start-End: 202-1596
ggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagggctatgtgacctttgaggatgtggctgtctacttctcccaggaggaatggagattgcttgatgacgctcagaggctcctctaccgcaatgtgatgctggagaactttacacttctggcctctctgggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttacactggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccatacacccttatgaccatt

SEQ ID NO: 202448 - DNA, 1857 bp, Homo sapiens
  Payload ID: 19927
  Gene Name: zinc finger protein 419
  Uniprot ID: Q96HQ0
  ENST ID: ENST00000442920
  CDS Start-End: 234-1727
acgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagggctatgtgacctttgaggatgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtt

SEQ ID NO: 202449 - DNA, 746 bp, Homo sapiens
  Payload ID: 19927
  Gene Name: zinc finger protein 419
  ENST ID: ENST00000518999
  CDS Start-End: 181-513
ggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggttcctgtggctgcagacttgcttacagaccatgaggagcagggctatgtgacctttgaggatgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccataccgagaggtagttggtgggtggagctcagggaggtgtgaactcagggatggattcatatcataccagtaggcccagatattttgataccaaggcaaggggttgtcgctgatttctatcttttcttccttagtcacccatttatatctattctgatgtttgacctagggccattccccacctctctgtcctccatgtttcacccagtcatcagcagaacccttcagcagtggctttcactgaatgtgtggtgaggtggatgcttatccttgca

SEQ ID NO: 202450 - DNA, 577 bp, Homo sapiens
  Payload ID: 19927
  Gene Name: zinc finger protein 419
  ENST ID: ENST00000523882
  CDS Start-End: 234-577
acgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggttcctgtggctgcagacttgcttacagaccatgaggagcagggctatgtgacctttgaggatgtggctgtctacttctcccaggaggaatggagattgcttgatgacgctcagaggctcctctaccgcaatgtgatgctggagaactttacacttctggcctctctgggtaaggttctcacaccccaccccagcatcctgagctgggctcggcttttcctccttttcctagggagaggtctgttcttcccaaagctgaactgtgggcactcattccttctccagtatcctgaagtagctattgtaatagg

SEQ ID NO: 202451 - DNA, 572 bp, Homo sapiens
  Payload ID: 19927
  Gene Name: zinc finger protein 419
  ENST ID: ENST00000523312
  CDS Start-End: 232-572
gcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagggctatgtgacctttgaggatgtggctgtctacttctcccaggaggaatggagattgcttgatgacgctcagaggctcctctaccgcaatgtgatgctggagaactttacacttctggcctctctgggtaaggttctcacaccccaccccagcatcctgagctgggctcggcttttcctccttttcctagggagaggtctgttcttcccaaagctgaactgtgggcactcattccttctccagtatcctgaagtagctattgtaataggcctgggctgtgtatactaccaccttctctccccaagctg

SEQ ID NO: 202452 - DNA, 561 bp, Homo sapiens
  Payload ID: 19927
  Gene Name: zinc finger protein 419
  ENST ID: ENST00000521754
  CDS Start-End: 199-561
attcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagcagggctatgtgacctttgaggatgtggctgtctacttctcccaggaggaatggagattgcttgatgacgctcagaggctcctctaccgcaatgtgatgctggagaactttacacttctggcctctctgggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaag

SEQ ID NO: 202453 - DNA, 568 bp, Homo sapiens
  Payload ID: 19927
  Gene Name: zinc finger protein 419
  ENST ID: ENST00000520540
  CDS Start-End: 234-527
acgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagcagggctatgtgacctttgaggatgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccataccgagaggtagttggtgggtggagctcagggaggtgtgaactcagggatggattcatatcataccagtaggcccagatat

SEQ ID NO: 202454 - DNA, 462 bp, Homo sapiens
  Payload ID: 19927
  Gene Name: zinc finger protein 419
  ENST ID: ENST00000523138
  CDS Start-End: 202-462
ggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggttcctgtggctgcagacttgcttacagaccatgaggagggctatgtgacctttgaggatgtggctgtctacttctcccaggaggaatggagattgcttgatgacgctcagaggctcctctaccgcaatgtgatgctggagaactttacacttctggcctctctgggtaaggttctcacaccccaccccagcatcctgagctgggctcggcttttcctccttttccta

SEQ ID NO: 202455 - DNA, 690 bp, Homo sapiens
  Payload ID: 19927
  Gene Name: zinc finger protein 419
  ENST ID: ENST00000521137
  CDS Start-End: 171-690
cctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggttcctgtggctgcagacttgcttacagaccatgaggagggctatgtgacctttgaggatgtggctgtctacttctcccaggaggaatggagattgcttgatgacgctcagaggctcctctaccgcaatgtgatgctggagaactttacacttctggcctctctgggttgttggcatggagccgaggctgaggaggctcctgagcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtg

SEQ ID NO: 202456 - DNA, 567 bp, Homo sapiens
  Payload ID: 19927
  Gene Name: zinc finger protein 419
  ENST ID: ENST00000519310
  CDS Start-End: 418-567
acgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcagtcttgattttccataggttcctgtggctgcagacttgcttacagaccatgaggagcagggctatgtgacctttgaggatgtggctgtctacttctcccaggaggaatggagattgcttgatgacgctcagaggctcctctaccgcaatgtgatgctggagaactttacacttctggcctctctgggttgttggcatggagccgaggctgaggaggctcctgagcagattgcttctgtaggactgctcagttcaaacattcagcaacaccagaagcagcactgtggagagaaacccttaaaa

SEQ ID NO: 202457 - DNA, 1281 bp, Homo sapiens
  Payload ID: 19927
  Gene Name: zinc finger protein 419
  ENST ID: ENST00000618093
  CDS Start-End: 1-1281
cagggctatgtgacctttgaggatgtggctgtctacttctcccaggaggaatggagattgcttgatgacgctcagaggctcctctaccgcaatgtgatgctggagaactttacacttctggcctctctgggtaaggttctcacaccccaccccagcatcctgagctgggctcggcttttcctccttttcctagggagaggtctgttcttcccaaagctgaactttgtgacttcagccataccgagaggtagttgggccattccccacctctctgtcctccatgtttcacccagtcatcagcagaacccttcagcagtggctttcactgaatgtgtgcagattgcttctgtaggactgctcagttcaaacattcagcaacaccagaagcagcactgtggagagaaacccttaaaaagacaagagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagaattcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagcct

SEQ ID NO: 202458 - DNA, 1945 bp, Homo sapiens
  Payload ID: 19928
  Gene Name: zinc finger protein 420
  Uniprot ID: Q8TAQ5
  ENST ID: ENST00000304239
  CDS Start-End: 261-1871
gatttggaggcctcgcgtggggagagggccgcgtctgtggaggagcttggctccgcacctgctgggctggcgaacccgaaattgggcttggaacccgggagccagatcttggaccctgaactgcacctctgtcaagagcccagaggagaaagaatggctgtttcagtagcaatgtccaagctctgcattctccagactctgtgctttcctaagataggaacccagaagaggactgatcatttcttgcagctctaaaaaccatggctcggaaattagtgatgttcagggatgttgccattgacttctctcaggaagagtgggaatgcctggactctgctcagagagatttgtatagagatgtgatgttggagaactatagcaacttggtatcactagacttgccttcaaggtgtgcaagtaaggacttatctccagaaaagaacacttatgaaacagaattatcccaatgggaaatgagtgacagacttgaaaactgtgatcttgaagagtccaattccagggattatttggaagccaaaggcaagatggagaagcaacaagaaaatcagaaggaatatttcaggcaagggatgatcatatatgacaaaatgtccattttcaaccagcatacttacttatctcaacattcaagatgtcattctactgagaaaccctataaatgtaaggaatgtgggaaagccttcagacgagcctcacacctaacacaacatcaaagtattcatactggtgaaaaaccctatgaatgtaagcaatgcgggaaggcctttagtcgtgattcacaactcagtcttcatcagagacttcatactggtgagaaaccctatgcatgtaaggaatgtgggaaggcctttactcaaagctcacaacttattttacatcatagaattcatactggtgaaaaaccatataaatgtgaagaatgtgggaaagcctttattcgtagctcacaacttacccgacatcaaaaagttcatactggtgagaaaccttatgaatgtaaagaatgtgggaaggcctttactcagaattcacaacttacactacaccagagacttcatactggtgaaaagctctatgaatgtaaagaatgtaggaaggtctttactcagctctcacaacttattctgcataagagaattcataccggtgagaaaccctatgaatgtaaggaatgtggaaaagcttttatttgtggctcacagctttctcaacatcagaaaattcataatggggaaaaaccatatgaatgtaaggaatgtggaagggcctttattcggggctcactactgatgcaacatcagaggattcatactggtgaaaaaccctataaatgtgaagaatgtgggaaggcctttatccgtggctcacaacttactcaacaccagagaattcacaccaatgaaaagccctatgaatgtaaggaatgtggaaagatgtttagtcatggctcacaacttactcaacatcagagaatacacactggtgagaaaccctatcaatgtaaggaatgtggaaaagcgtttaatcgtggctcactccttacacgacaccagaggattcatactggtgagaaaccctatgaatgtaaagaatgtggaaaaacctttagtcgtggctcagaacttactcaacatgagcgaattcacacagccttccttgcaggtcaacaagatagaagtgatatttatatgagtaggagatttacgaaatccatttttcctgtctttttttccgtgcctacaatgtggacatctaagctggagctccgttactctcatggggactttgagaatggtatctgggtgttatggatcatggagcagaaatacagaaggagtctgcaaccctgatgactttgtggaacagccatactagctctggtctgcttgcctcctgtttctctttaaataaaattaaacatctt

SEQ ID NO: 202459 - DNA, 3535 bp, Homo sapiens
  Payload ID: 19928
  Gene Name: zinc finger protein 420
  Uniprot ID: Q8TAQ5
  ENST ID: ENST00000337995
  CDS Start-End: 216-2282
cttggctccgcacctgctgggctggcgaacccgaaattgggcttggaacccgggagccagatcttggaccctgaactgcacctctgtcaagagcccagaggagaaagaatggctgtttcagtagcaatgtccaagctctgcattctccagactctgtgctttcctaagataggaacccagaagaggactgatcatttcttgcagctctaaaaaccatggctcggaaattagtgatgttcagggatgttgccattgacttctctcaggaagagtgggaatgcctggactctgctcagagagatttgtatagagatgtgatgttggagaactatagcaacttggtatcactagacttgccttcaaggtgtgcaagtaaggacttatctccagaaaagaacacttatgaaacagaattatcccaatgggaaatgagtgacagacttgaaaactgtgatcttgaagagtccaattccagggattatttggaagccaaaggcaagatggagaagcaacaagaaaatcagaaggaatatttcaggcaagggatgatcatatatgacaaaatgtccattttcaaccagcatacttacttatctcaacattcaagatgtcattctactgagaaaccctataaatgtaaggaatgtgggaaagccttcagacgagcctcacacctaacacaacatcaaagtattcatactggtgaaaaaccctatgaatgtaagcaatgcgggaaggcctttagtcgtgattcacaactcagtcttcatcagagacttcatactggtgagaaaccctatgcatgtaaggaatgtgggaaggcctttactcaaagctcacaacttattttacatcatagaattcatactggtgaaaaaccatataaatgtgaagaatgtgggaaagcctttattcgtagctcacaacttacccgacatcaaaaagttcatactggtgagaaaccttatgaatgtaaagaatgtgggaaggcctttactcagaattcacaacttacactacaccagagacttcatactggtgaaaagctctatgaatgtaaagaatgtaggaaggtctttactcagctctcacaacttattctgcataagagaattcataccggtgagaaaccctatgaatgtaaggaatgtggaaaagcttttatttgtggctcacagctttctcaacatcagaaaattcataatggggaaaaaccatatgaatgtaaggaatgtggaagggcctttattcggggctcactactgatgcaacatcagaggattcatactggtgaaaaaccctataaatgtgaagaatgtgggaaggcctttatccgtggctcacaacttactcaacaccagagaattcacaccaatgaaaagccctatgaatgtaaggaatgtggaaagatgtttagtcatggctcacaacttactcaacatcagagaatacacactggtgagaaaccctatcaatgtaaggaatgtggaaaagcgtttaatcgtggctcactccttacacgacaccagaggattcatactggtgagaaaccctatgaatgtaaagaatgtggaaaaacctttagtcgtggctcagaacttactcaacatgagcgaattcacacaggtgagaaaccctatgaatgtaaggaatgtgggaaatcttttattcgtggttcccagcttactcaacatcagagaatccatactggtgagaaaccttatgaatgtaaagaatgtagaatggcctttactcagagttcacatctttcccaacatcaaagacttcacactggtgagaaaccctatgtgtgtaatgaatgtggaaaggcctttgcgcgtggcttactacttatacaacatcagagaattcatactggtgagaaaccatatcaatgtaaggaatgtgggaaagcctttattcgtggttcacagttgactcaacatcagcgaattcacactggagaaaaaccctatgaatgcaaggagtgtggcaaggcctttagtcatggctctcagcttactctacatcagagaatccatactggtgagaagccctatgaatgcagagaatgtagaaaggcctttactcagagttcacatctttctcggcatcagagaattcatactggtgagaaaccatatcaatgtaaggaatgtgggaaggcctttactcgtggttcacagctaactcaacatcagagaattcatatcagtgagaaatcttttgaatataaggaatgtgggattgactttagtcatggctcacaagtttacatgtgaattgtctgattatttgagatcactatgaagaggttctctggttgttagcagcaaagaattctcacaaatgtgaatatgggcgcacatttgcctcataaagcacagcatcagataatttatgtgagagaaaatggtagtgtcattcatatagaaaaacatcattactggaaacctattaaacattagcaaattggagaatagttttaatatagtaaatgtaggaagccctttagccatattgaaaacaaatatctttttcaacgttatcttagctctactagttgatctttttgttatatgtatcatgatacttaacctctaccttggtttaatcattttaagatagacctaagtatattacctttattgtaagattcttggaagtattatgtaagttattacatgtaaaagctcttagaatggtgccttgaacgtagcataccacaaatattagctaccattttcactagtgttattttagagaatttgcatgagaggagagtacttatgagtataatgaatattgagaaatcttttatcaacacatccaagatgacttggttggggggcactgtatgccataatgaatgtgagaaagctgtcatttaaatctcatccattattgctataagaggaaattcatactgttaaaaaaaaaaaaacccagtggatataatcagtgtattattaaaaaaaaaaaaacccagtggatgtaatcagtgtattattgagcacagctgttagagaagtgggacaaggtgtgaagtgatttttaacgaagtctaagatccaaagtctaataaatctaggaattttttaaaaacttgaatgtattgcttttgaagtaaacaaaataactgatattacagactattttgcaatgaaaaatgatgagagtttgtgatacagactgcttttttcctaccctatatctattttctcttttttagtaacaaatttctgggctgaaaatctcagccttccttgcaggtcaacaagatagaagtgatatttatatgagtaggagatttacgaaatccatttttcctgtctttttttccgtgcctacaatgtggacatctaagctggagctccgttactctcatggggactttgagaatggtatctgggtgttatggatcatggagcagaaatacagaaggagtctgcaaccctgatgactttgtggaacagccatactagctctggtctgcttgcctcctgtttctctttaaataaaattaaacatctta

SEQ ID NO: 202460 - DNA, 537 bp, Homo sapiens
  Payload ID: 19928
  Gene Name: zinc finger protein 420
  ENST ID: ENST00000589461
  CDS Start-End: 278-433
tttccgttagtttgcgagatttggaggcctcgcgtggggagagggccgcgtctgtggaggagcttggctccgcacctgctgggctggcgaacccgaaattgggcttggaacccgggagccagatcttggaccctgaactgcacctctgtcaagagcccagaggagaaagaatggctgtttcagtagcaatgtccaagctctgcattctccagactctgtgctttcctaagataggaacccagaagaggactgatcatttcttgcagctctaaaaaccatggctcggaaattagtgatgttcagggatgttgccattgacttctctcaggaagagtgggaatgcctggactctgctcagagagatttgtatagagatgtgatgttggagaactatagcaacttggtatcactagcacatcaaatatcaacgtaatgaataacagtctgaaaacttatctctaactggttgaagagcttgacctacgaaagtctgacaaatagttggactattaagcattccctgagacttgccttcaa

SEQ ID NO: 202461 - DNA, 612 bp, Homo sapiens
  Payload ID: 19928
  Gene Name: zinc finger protein 420
  ENST ID: ENST00000587029
  CDS Start-End: 349-612
aaaccagtccctgaggcttgggaaagcaggagccctccgcggcagtgcgtcggtgtcgaggctccgaggctccggcctcacctctccaggaggtcgacagaacgacaggacgttctccgaatgccaggagtcgcagagggcagagcaggatgaagaaaccacaggcggagtctaggggaagcagtacggcgtccctgcctcaggcctgcccggacggtgtgcggagcccagaggagaaagaatggctgtttcagtagcaatgtccaagctctgcattctccagactctgtgctttcctaagataggaacccagaagaggactgatcatttcttgcagctctaaaaaccatggctcggaaattagtgatgttcagggatgttgccattgacttctctcaggaagagtgggaatgcctggactctgctcagagagatttgtatagagatgtgatgttggagaactatagcaacttggtatcactagacttgccttcaaggtgtgcaagtaaggacttatctccagaaaagaacacttatgaaacagaattatcccaatgggaaatgagtgacagacttgaaaactgtgatcttgaagagtccaattccagggat

SEQ ID NO: 202462 - DNA, 571 bp, Homo sapiens
  Payload ID: 19928
  Gene Name: zinc finger protein 420
  ENST ID: ENST00000587082
  CDS Start-End: 263-406
gagatttggaggcctcgcgtggggagagggccgcgtctgtggaggagcttggctccgcacctgctgggctggcgaacccgaaattgggcttggaacccgggagccagatcttggaccctgaactgcacctctgtcaagagcccagaggagaaagaatggctgtttcagtagcaatgtccaagctctgcattctccagactctgtgctttcctaagataggaacccagaagaggactgatcatttcttgcagctctaaaaaccatggctcggaaattagtgatgttcagggatgttgccattgacttctctcaggaagagtgggaatgcctggactctgctcagagagatttgtatagagatgtgatgttggagaactatagcaacttggtatcactagcactctgaagatattattccactgtcctctggcttctattgttgctcttgagaagtctgccatctgtttcattgttattccttttcacatcaaatatcaacgtaatgaataacagtctgaaaacttatctctaactggttgaagagcttgacctacgaaagtctgacaaatag

SEQ ID NO: 202463 - DNA, 695 bp, Homo sapiens
  Payload ID: 19928
  Gene Name: zinc finger protein 420
  ENST ID: ENST00000589245
  CDS Start-End: 206-695
ctcgcgtggggagagggccgcgtctgtggaggagcttggctccgcacctgctgggctggcgaacccgaaattgggcttggaacccgggagccagatcttggaccctgaactgcacctctgtcaagctctgcattctccagactctgtgctttcctaagataggaacccagaagaggactgatcatttcttgcagctctaaaaaccatggctcggaaattagtgatgttcagggatgttgccattgacttctctcaggaagagtgggaatgcctggactctgctcagagagatttgtatagagatgtgatgttggagaactatagcaacttggtatcactagacttgccttcaaggtgtgcaagtaaggacttatctccagaaaagaacacttatgaaacagaattatcccaatgggaaatgagtgacagacttgaaaactgtgatcttgaagagtccaattccagggattatttggaagccaaaggcaagatggagaagcaacaagaaaatcagaaggaatatttcaggcaagggatgatcatatatgacaaaatgtccattttcaaccagcatacttacttatctcaacattcaagatgtcattctactgagaaaccctataaatgtaaggaatgtgggaaagccttcagacgagcctcacacctaacacaacatcaaagtattcatactggtg

SEQ ID NO: 202464 - DNA, 541 bp, Homo sapiens
  Payload ID: 19928
  Gene Name: zinc finger protein 420
  ENST ID: ENST00000590332
  CDS Start-End: 304-541
agaaaccagtccctgaggcttgggaaagcaggagccctccgcggcagtgcgtcggtgtcgaggctccgaggctccggcctcacctctccaggaggtcgacagaacgacaggacgttctccgaatgccaggagtcgcagagggcagagcaggatgaagaaaccacaggcggagtctaggggaagcagtacggcgtccctgcctcaggcctgcccggacggtgtgcggacttgccttcaaggtgtgcaagtaaggacttatctccagaaaagaacacttatgaaacagaattatcccaatgggaaatgagtgacagacttgaaaactgtgatcttgaagagtccaattccagggattatttggaagccaaaggcaagatggagaagcaacaagaaaatcagaaggaatatttcaggcaagggatgatcatatatgacaaaatgtccattttcaaccagcatacttacttatctcaacattcaagatgtcattctactgagaaaccctataaatgtaaggaatgtgggaaagccttcagacgag

SEQ ID NO: 202465 - DNA, 403 bp, Homo sapiens
  Payload ID: 19928
  Gene Name: zinc finger protein 420
  ENST ID: ENST00000585862
  CDS Start-End: 1-268
atgtaaggaatgtggaaagatgtttagtcatggctcacaacttactcaacatcagagaatacacactggtgagaaaccctatcaatgtaaggaatgtggaaaagcgtttaatcgtggctcactccttacacgacaccagaggattcatactggtgagaaaccctatgaatgtaaagaatgtggaaaaacctttagtcgtggctcagaacttactcaacatgagcgaattcacacagctggagctccgttactctcatggggactttgagaatggtatctgggtgttatggatcatggagcagaaatacagaaggagtctgcaaccctgatgactttgtggaacagccatactagctctggtctgcttgcctcctgtttctctttaaataaaattaaacatctt

SEQ ID NO: 202466 - DNA, 4578 bp, Homo sapiens
  Payload ID: 19929
  Gene Name: zinc finger protein 423
  Uniprot ID: Q2M1K9
  ENST ID: ENST00000262383
  CDS Start-End: 54-3908
gaaaacttcctggagaaggatggattttaccctgtaaaagaagaaagacatggatgcataagaagagggttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccaccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcgattagc

SEQ ID NO: 202467 - DNA, 4201 bp, Homo sapiens
  Payload ID: 19929
  Gene Name: zinc finger protein 423
  ENST ID: ENST00000535559
  CDS Start-End: 210-3713
accagtgggccggtgggaagcgcctctccagccctcgcctgccctgccgccgggtgctgggaacccgggctcaggttctggccctcttggcatcggccagtttgccctgggacgccctggtgagcagggggaaagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccaccccccacccccttcggttaactactttttaattgcaattctaggtaattgtgcatcgtgatgtgattgcttggctattgtctgaatattt

SEQ ID NO: 202468 - DNA, 4017 bp, Homo sapiens
  Payload ID: 19929
  Gene Name: zinc finger protein 423
  ENST ID: ENST00000567169
  CDS Start-End: 190-3693
atccttcccgtctgccgagcccgtcatgtgaggcccccgggggagaaggtgctggtgctctgggagggtgttccaggaggccccttgagctgggctggggagctgggcttcagagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgata

SEQ ID NO: 202469 - DNA, 7907 bp, Homo sapiens
  Payload ID: 19929
  Gene Name: zinc finger protein 423
  Uniprot ID: Q2M1K9
  ENST ID: ENST00000561648
  CDS Start-End: 302-4156
gaagaaaatcaaaccctccggaatgtccccctgaagaggaccactgttgcagcggggaccctcctttcaggcatcctcattttatcatgtccctttgctttcttccccagtggccttttcaaaggtcagagagaaatgcttagtcaaacccctacttgagtatcacaggtgactaattttgggatcgaagattaaggaggttttgttgcgtccttaaagaacttggaattggagtccaggtagttttggaaaacttcctggagaaggatggattttaccctgtaaaagaagaaagacatggatgcataagaagagggttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccaccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcgattagcatccggctgcctggttctctcctccccagcctagggccgcgtggggggctgtcagctcctgtaaggtgtgttcccctacaagttcctgtgggcttgcacacgcccttggggacctgcacacaatagaccctgctccccttggaaaagaatcgtagtaacctaatgcatgcagactggacaggctggcagtggccacaggagtcaaagcagaagaccccttaatgatggaataccctgatcttcccactcttggatggggaaacagaggcccaagggtaacgtgcagctttcccaaggccacgcagcaggttggtcaccatgctgattgtgaagtcttcttggctttcccttcagggttggctttcccctttgttggatacaggcaggcaagtgggtagcccttcccttgccaggactccaggtggcacttgggttctgaggcacggagatgtgtgactggggactgcagagcagagccaggtaggagccgcaggttcccagtcatagagatcagtaggatgtgagagcattgagactggtggcgggggccaggtctggagtgaggcaggcaggggcctggggtacattatttcagggggcactcgctctcagggcccccctacacctgcaagtgctgggaatgggtgtcctcttgcattttacactctaggcaccttgcttatttcacctactcctggccctgctggcctcccagggcccacccagcagccttggtctccaggcctcctccatgttacctcccacacctccatcatgctggtgctcagctgacttgccaatcagaggccagaacttgcacggggaaacccttccttgctaacttttcacaaggggcaaggaaattggttattaccctctgcagagcggaaatgaaacaggcagacagattgcacctaattataatgtaatactaagtcacgggtgtggaatttggagcaattatacccatcatcttctagaagactcccatatcaaggggcttctggtgacctataagagttcccctttctttctgtcacctcatgtaatgttctcacgcgggtggggctttcagtttttcaaaaggcatcttacatatgtgaatcatagagcagaccctgccagtagtgggctgttgcctcctggaaactgaaggctgtgaatgccaattttcagcctcctggagacctggcagttttgggggaagaccccagggtagacaccagtgttcctctaagtgtgcccacccgtggactggggcttggggcctggggctggggctatgtctgagtgaggctgccacacatccacagccaggcctaccttttgggcagtgctgggactgtcgatgggaccagtatgtcccggggcctgccacatctccgtctcagggccctctccagctctggatttatcccaaaccccatggagcccaggtgagccctcagtaactaccaatagaagattcgatttgacggttggtggcgtagggctaaattagtcactgcccccattaaaaatacagcggggggtttaagagcttttcacgccatgtgggaatcagcagcgaagccggctgatgccttgggtaaggagagaggcggcctaggggaccgtgaggtaatgaggtttatggcggtgacaaggcagccagggaaccccaccgactcccccctcaccccggccgcattgttctccggctggctctgtccctgctgctacggctgagagcccctcgtgactttgtgtggggagggggctggcagtggggaccctgaggcccttcctgggactggcattctttaccatcaggtggtattagggttggggagcagtgtagggttataaacctgtgcctcggagaactcactaaccccttccagaggaaaggtctggagctgggatgagacacttgcctttcaactgtgaggggccttagagggtctctgggaggcttgtatgaagtgatgcctgacaaagggctgcacacagagacctgtaagcagcatggtcatcaatgatggtgccaggcatcctgcaggagggcaccttttcagccaggagggcgcgatggaatcagcctctcatttggatttggctttggggagtgggcgaggtgactgaaagcctaaggttcattgctgctgtatttagatgtacaaattgtcagtttctagcggctctctgggcagaggaattttgcccaggctgggaaatggaccaggacccttgggccacaggcccctgtcatggaacacctgcccagagtgcccagaagcaggcaggtaagggtttcagtctcagtggagaaactgtcatgggagaaatcttctcgagttccccagccttaaagaacgctccttttaaattcacagttgtgtaatattgaacttttcacctgtttttcttccctcctaaggtgtgtgttcctagggatggaacctgtacctataaatattcagtaaataggaccaaaactcaaatccatcccttcctctactcatccattcagcaagtatttactgagctgcccccaggtgccaggcactgcacagggcactggggataaggagatgaccagcagatgtggtccctggcctcatggaggccacagtggcacaggcaagcatgccagtaaatgcatagccacacctggtcatgagtgccgtgatggcaaagccagaagctgccagggattaatggagggacccgtgtatgagacacaggggtgcattaaggaaggccttgctgaggcaggggcttgagacctgaagaaataagggaggtgggcagtccaagagcagtgggaagagaacactgcaaatgcagaagccgtgagctggaaacgagccagaagtacccttagagagctgtattcctatggagtttcaattctaggtggcttaaaacaatcccagagaagttcagaatcttgtccaagatcataccattcaggatagacttgcgactataacttgggtgcctcaccttccagcctggggtgtctgactccattgttaattttattataacaatcatgatgacaacgatgaataaagtgaaattgtactgtacaggaaa

SEQ ID NO: 202470 - DNA, 4911 bp, Homo sapiens
  Payload ID: 19929
  Gene Name: zinc finger protein 423
  Uniprot ID: Q2M1K9
  ENST ID: ENST00000563137
  CDS Start-End: 566-4240
ttttttttttttttttttttttgcataactcggctcggccgagtggcctccggactccccgcgccgctgggaccgccgcttggatcgggagccccggactgccgcattgcaacaggcagggccccggcgcgccccccgggcctccccccgccttcgagcggcctcggccggcccgggctgcccccccaagggaggccgccccggacctgcggtccgctccccacagccgccaaccgggctgcaaaaaaaaaagtttccaagagacaggcggaggagaagggggagaagggctgcccggagcggcggggggcggcggggggagccggctgcggagggcgacggagcgcccggagccccggacatgtccaggcggaagcaggcgaagccgcgctcggtgaaagttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccaccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcgattagca

SEQ ID NO: 202471 - DNA, 4018 bp, Homo sapiens
  Payload ID: 19929
  Gene Name: zinc finger protein 423
  Uniprot ID: Q2M1K9
  ENST ID: ENST00000562520
  CDS Start-End: 344-4018
ttttcccaagtcagaacccttcccgggcctgcccggagaccagagtctcagccggttcaggagctgcgggggacgcgcggcgccccctggcggctgggtaaaacctcgcagaaagtagcagctggtttatttcttctgacaactgcgcggggagggggtgctcctgcaaggtctcagggttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtga

SEQ ID NO: 202472 - DNA, 4514 bp, Homo sapiens
  Payload ID: 19929
  Gene Name: zinc finger protein 423
  Uniprot ID: Q2M1K9
  ENST ID: ENST00000562871
  CDS Start-End: 170-3844
cacagggggcctcagaaatcgtcaggtggtgactggagctgagaggtggccactctgttaccatggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccaccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcgattagc

SEQ ID NO: 202473 - DNA, 456 bp, Homo sapiens
  Payload ID: 19929
  Gene Name: zinc finger protein 423
  ENST ID: ENST00000568094
  CDS Start-End: 1-308
ttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggaggtaatgcaaaacagccccaggactctgacaggtggttacacgggtaattggacatagcaacagcttgaagcctcaagtgagattaaagaattaataatgtaattttacagttaatgtcattttattgtggtgtcttgggtaccctgtatccgccttttaaatacaattaaaaataaaagcaacagctttccggca

SEQ ID NO: 202474 - DNA, 3220 bp, Homo sapiens
  Payload ID: 19930
  Gene Name: zinc finger protein 425
  Uniprot ID: Q6IV72
  ENST ID: ENST00000378061
  CDS Start-End: 134-2392
gcgccgagtcccagcatgcaccgcgcccggccggctctgcctttgggggccagcagggctgtacctgggagttgggttggggcggagcggaggggaggccgtgccaggcagggccggttcgtgcggaaccgccatggccgagccggcttcggtaactgtgacatttgatgatgtggccttatatttttcggaacaagagtgggagatcctggagaagtggcagaagcaaatgtataagcaagagatgaagaccaattacgagacccttgattccctggggtatgctttttccaagccagatttgatcacatggatggaacaagggagaatgctattaatcagcgaacagggatgcttagataaaacaagaaggacaactagccctcctactgatgaacagttgaacatgaagaatactggaaagttgctatgttttgatgacgaaggaactcccaggacaaaagaagaggattgccgtttaaatggtcctcaaaaacaggacttgtgtgctgccttacgagggaaagagagaaagattttattagctcaaacagccaccttccagtctccaagtctccgagaaacagagattctaaataaaaaagtcagcatcacagcatatgatccagacaagaaagacctgcggcataagcctcgggagaccccagggcgcttagaaattcccacagggccaagatgctattcctgctatgtctgtaggaaagtcttccaagtaaggagggatttgctaaagcacaaacggagccactccaagagccagctctgcagatacccaaagtacaaaaactcgtccagagggaagtccgaactcaggcggacgcagaggctcctgtgtcagaagaagcggttccagtgcagtgagtgtgagaagagctacttcctgaagggcagcctcgtcactcatcaggttgtccacaccggccagcggccctacccatgccctgagtgcgacaagaccttccggtacagggccaacctgaagaagcacctgtgtctacaccgcggggagcggccgttctgctgcggggagtgcggccgggccttcgtgcagcagtgcgagctcacggagcacttgcggctgcacagcggagagaagcccttccagtgtccgcagtgtgaccggtgcttccgcctgaagaggggcatgaaggtccatctgacccagcacagcgggaagaggcccttccactgtcccgagtgtggccggagcttctcccggaaggctgccctgaagacccaccagaggacgcacagcgaggaaaagccgttttcttgtggtgaatgtggcaggaaattcatctacaagattaagctggacgagcacatcagagttcacacgggagagaagcccttttcgtgtcccgagtgtaacaaaagtttccgcctcaagagaagcctgaaagcccacgggctgcagcacattgggaagcggcccttccagtgcccggagtgcagcaggggcttcttctggaggaacgccatgcgcgcccaccagcgcctgcacagcgagcaaaagcccttcccctgcgccgagtgcggcaagcgcttcacgcggccttccaagctcgcctgccacaccagagtccacgacaggcagaaggagtttccctgcggcgagtgcaaaaagaccttttctcagcagtcgcggctcacgcagcacctgaaggtccacaccacggaaaagccgttctcctgcgccgagtgcggccgcagtttccgccgacgcgcgcatctcacagagcacacgaggcttcacagtggcgaggagcccttccagtgtcccgagtgcgacaagagcttctcctggaaggcctccatgaagttccaccagcggatgcacagggacgagaagcccttcgcgtgcggtgagtgtgacaagacctacacgcatcagtctcagctcaccgagcacctgaggctgcacagtggagagaagccctaccagtgtcctgaatgcgagaagactttccgcctcaagggaaacctgaaaagccacctgctgcagcacagtggccaaaagccattctcttgtgtgatgtgcggcaaaagtttcactcaacagtaccggctcacagaacacattcgagtccacagcggggagaagcccttccagtgtccggagtgtgacaagagctactgcatcaggggcagcttgaaggtccacttgtataagcacagtggagagaggcccttccagtgtcccgagtgtggcaaaggcttcctccagaagagaagcctgaaggcccatctgtgccttcacagtggggagaggcctttttcttgtgatgagtgtggaaggagcttcacgtacgtgggggcgctcaagacccacattgcagtgcatgccaaagagaagccctccagcctctaggtcaggccatgcagcagtcacgcagtcggctttcaggaggtgccagcagctctgttggctcaagttgaggcaggttgaaggattcacagggtaagatcgggcacagtggctcccgcctgtaatcccattactttgggaggcccaggtgggaggatcgcttgagcccagaagtttgagaccagcctaggcaacattgcaagactccatctctacaaaaaatataaaagtcagccaggcgttgtggtgcatgcttgtggtcccagctactttgggaggttgaggcaggaggatcgcttgagcccaggaggcagaggctgcagtgagccatgctcacaccactgcactccagcctgggtgacagagcaagatcttgtctcaaaaaagaaaaaaaatcacaaaatactggctacagacacactggacaggtgtgtggtctgcagaactctatggctccttgacaaaagttccaaataatccatagacagtcaaagagacatctccctcaataatcgtcataggaaagacgtgccagttgtggaggaaacattcacactgatctgctagtccaacgatctcttcagtgtcatccaataatcccttcattaaattcagaaactacagcctgagtgaagaaatgttacagccaggaacatattcctcagtcagcttttccattaccaggccattttacttaaatctgtattaaagtcttcagttttctctcatagtggattttcattttctctcagatggtgagagggcttctgtttcttggaatgtttccatattgctaaaaataaatgtcttccactatctcatttgttaaaa

SEQ ID NO: 202475 - DNA, 541 bp, Homo sapiens
  Payload ID: 19930
  Gene Name: zinc finger protein 425
  ENST ID: ENST00000483014
  CDS Start-End: 94-541
ctttgggggccagcagggctgtacctgggagttgggttggggcggagcggaggggaggccgtgccaggcagggccggttcgtgcggaaccgccatggccgagccggcttcggtaagaagggccggtggaggatgcaggctctgtcgaaactcgggtccctgtcgcagctggattggggtaactgtgacatttgatgatgtggccttatatttttcggaacaagagtgggagatcctggagaagtggcagaagcaaatgtataagcaagagatgaagaccaattacgagacccttgattccctggggtatgctttttccaagccagatttgatcacatggatggaacaagggagaatgctattaatcagcgaacagggatgcttagataaaacaagaaggacaactagccctcctactgatgaacagttgaacatgaagaatactggaaagttgctatgttttgatgacgaaggaactcccaggacaaaagaagaggattgccgtttaaatggtcctcaaaaacaggacttgtgtgctgcct

SEQ ID NO: 202476 - DNA, 7085 bp, Homo sapiens
  Payload ID: 19931
  Gene Name: zinc finger protein 426
  Uniprot ID: Q9BUY5
  ENST ID: ENST00000253115
  CDS Start-End: 265-1929
gtgagcgcctgagagtctttttgcctttcagagttaaggcctcactggcctgggaaaataattgctgccttttgcatccgcgttggctccgtccccaggatcttcccggttcagggacctggcgatttctgagtgttccggaatcccaataaccctgtttaaagaggaatggagattgccactgtccatttagattaatgaggtgtcctgaagtgatggtgacatcaatgaaaggagggttctgacacgttctcacctcgcgggatggcagctgctgatttgtcccatggacattatctttctggggacccagtttgccttcatgaagaaaagacaccagcaggaagaatagtggctgactgcctaacagattgttatcaggattcagtgacctttgacgatgtggctgtggacttcacccaggaggagtggactttactggactcaactcagagaagcctctacagtgacgtgatgctggagaactacaagaacctggccacagtaggaggtcagatcatcaaacccagtctaatctcttggttggaacaagaagagtcaaggacagttcagggaggagttctccaaggatgggaaatgcgacttgaaacccagtggtctatacttcagcaggactttttgaggggtcagacatccattgggatacaattggaaggaaaacacaatggaagggaactctgtgactgtgagcaatgtggagaagtcttcagtgaacactcatgccttaagacgcacgtgagaactcaaagtacagggaacactcatgactgtaatcagtatggaaaagatttccttaccctgtgtgagaaaacctctactggtgagaaactttctgagtttaatcagagtgaaaaaatcttcagcctgacaccaaatattgtataccagagaactagcacacaagaaaagtcatttgaatgtagtcactgtggaaaatccttcattaatgagtcataccttcaggcacatatgagaactcacaatggagaaaaactctacgaatggaggaattatgggccaggttttattgactctacaagcctttctgtgcttatagaaaccctcaatgcaaaaaagccctacaaatgtaaggaatgtggaaaaggctatagatacccagcctacctcagtattcacatgcgaacccacactggggagaaaccatatgaatgtaaggaatgtgggaaagccttcaattattccaactcatttcagatacatggaagaactcacactggagagaaaccctatgtatgtaaggaatgtgggaaagccttcactcagtactcgggccttagtatgcatgtacgatctcacagtggagacaagccctatgaatgtaaggaatgtgggaaatccttccttacatcctcacgccttattcaacatataagaactcacactggagagaagccttttgtatgtgttgaatgtgggaaagcctttgcagtttcctcaaatcttagtggacatttgagaactcacactgaagagaaggcctgtgagtgtaagatatgtgggaaagtatttgggtatccctcatgtcttaataatcacatgcgaacgcacagtgcccagaaaccatacacctgtaaggaatgtgggaaggcttttaactattccacccaccttaaaattcacatgcgaatccacactggagaaaaaccctatgagtgtaaacaatgtggaaaggccttcagtcattccagttcatttcaaatacatgaaaggactcacactggagagaaaccctatgaatgcaaggagtgtgggaaagccttcacgtgttccagttcctttagaattcatgaaaaaactcacacagaagagaaaccctataaatgtcagcaatgcgggaaagcttacagtcatccccgttcacttcgaagacatgaacaaattcactagtgagaaactgtccatgtaataaatgtgggaaagctctcatttgttccagttcactttaaagacatgaatgaactcactctggagagaagaagctgcatgaaaattacttaattcctgtaatcccagcattttgagaggctgaggtgggtggatcacttgaggtcaggagtttgagaccaccctggccaacatggtgaaaccttgtctctactgaaaatacaaaaaatttagccaggtgtggtgggcacctgtaatcccagctacttgggaggctgaggcaagtgaatcacttgaacccaggaagcagaggttgcagtgagcagagatcatgccactgcactccagcctgggcgatggagtgagactccatctcaaaaaaaaaaaaaaaagaaaattatttgattaaattgagtctgttagagtacatccctaatccaatatgattggtgtccctataagaagagaaagacacaactgagacaacaaatagaagatgatgtgaagtcatcagatgatggccatctgcaagccaaagacagagcactgggacagatccttctatcaaagccaccaaccctgctggcaccttcatcttgggcttccagaactttgaacaaataaaattctcttgtttgagccacccagtctgtggtattttgttgtggtggctctagcaagtgaatacagtaagcaataagcaaaaacgtttatagattgtccaaaagccttaatattcacatgcaaagccacactggagagaaactatatgaatgtaagacgtgggagagccttcattgagtcttcagtcctttctacatacaggagaaatcacataggagagaaattgtatgaatgtaaggagcatgaaaaagcctgtgaatgttcactatattttaatattcacatgcaagttgtctggtcgtagaccatgtgaaaatagaggagaaaaaaggaaagaaagtttcttttactgtgaacgcaaggaatgtgaccccatacaccatactggaacttggagtggactgaaatcccattaggattgtggaaaagcttacattaatgttttctaccttctagaaggtgtaagaagtcgaactggagagaagccttttacctgtaatgcatgtaggaagccttacattaattccacagaattttttttacacatgtaaaattacctcagaaccctgggaaggtaaggaatatggtataacctttaaatatttcacatgccataataagtacatgaattctgataatactgtaccgtttcttgagtagtgttagtaccttatactatcaaaataatcctaaatcctccctctcagaccttccatcattactatatttcacttttatgcctataaacacacacaaattagcatatgtaatctaatacattgtagctatttttcagaagttatcagatcaattaagtattagaaaaataaacatttttattttaccttcacttcttccttctatgctcaaagttggatgtaattcttatacttgatcctcaatacttaaagcatttccccccctctggcttctatgaaaattttttgttatctttgatattctgttatttttaaatgatatgcctaggtataggtttttggtgctcgtccttcttggtgtttgcttagcctcctggatttgcgttttggtgtctgagttaattttgagaaattctgtcattgtttccctttttttttctttccatctggtatttcctttatatgtaggatacatcttttgtagttatcccacagttcttatatcttgtttttttattcttctctttgcttttcaggtgtggatgtttctgctgatatattctcaagctctttagttggctgtttcttggccaataataagcctaccaaagacattcttcatttctgttacactgtcttcaatttctagcatttctttgtggttcttagaatttccatctctgtgtttacactgcctgtctgttcttggatgctgtctgctttatccagtagaacccatggcatatcaatcataattgttttaaattcccagtctgataatttcagcaatcctgctatatctggttctggttcttactctttctctttaaactaacttttgccttttagtatgcttgtaatttttccttagctggacatggcatactggataagaggaaatgctgtaagcaggcctctagtaatcatgataagctgtggggagaggggcagcattctattgtccagggattagatgtcagtcttgcagtgagtctgtgcttctgcactgtgaacttcagtttttcccaccctttagttgggtcaggatgtatagagttggctggagttggatatttcccttcctccaggtcactgaagctctgactaaaactccaggtgtggtggcttatgcctgtaataccagcactttgggaggccaaggcaggtggatcacctgaggttgggagttcatgaccagcctgaattgcttgaatccaggaggtggaggtcacagtgagccgagattgtgatactgcactccagcctgggaaacagtgagacactgtctcaaaaaaataaataaataaataaaaggctaggcgcagtggctcaaccctgtaatcccagcactttgggaggcagaggtgggtggatcatgaggtcaggagatcgagaccatcctggccaacatggtgaaaccccgtctctactaaaaatacaaaaaaattagctgggtgtggtggcgggcacctgtagtcccagctacttgggaggctgaggcaggagaatggtgtgaacccaggaggtggagcttgcagtgagccgagatcacgccactgcactccagcctgggtgacagagtgagactctgtctcaaaacaacaacaacaacaacaacaacaaaaacccatcatcaatgctcagcctttcttaaacatgaactcatggtggacagagccctatgaatgtaaggaatatagagaagccatcactagttactcaaaccttattgaatgtgtgaaaatttactctggagagatgccctttcagcataagaaatgttgaaaaggatttatataatccttcctttttatttttatttttatttttatttttatttttattttttttgagacggagtctcgctctgtcgcccaggctggagtgcagtggtgcgatctcggctcactgcaagctccgcctcccgggttcacgccattctcctgcctcagcctcccgagtagctgggactacaggcgcccgctaccacgcccggctaattttttgtatttttagtagagacggggtttcactgtgttagccaggatggtctcgatctcctgacctcgtgatccgcccgcctcggcctcccaaagtgctgggattacaggcgtgagccaccgcgcccagccaatccttcctttttaatatccacatacaaactcactgaagaaaaaccctgaaaatgtaaagcaatgttgaaaaacctagttatttaaattcatttcaagtatatgaactcacatggtaaagaaaccctgtgaatataagtagtatgataaattcttgaatttttttttttttttttttttttttttgaggcagagttttgctcttgttgcccaggctggagtgcaatggctcaatcttggctcactacaacctctatcacccaggttcaagtgattattctgcctcagcctcccaagtagctgggattacaggcatgtaccaccatgcccagctaattttgtatttttagtgaaggcagggattctccatgttgatcaggctggtctcgaactcctgacctccagtgatctgcctggtttgacctcccaaagtgctgagattacaggcatgagccatcacgcccagccagttcttcaattcttacagtccctttccatgtcattaaagaactcacactggagagaaatcttatcaatgttagaattgtggtaaagctctctgttgttcccatttacatgaaagatgtgaacagtcacattgtagaaaaatgctgtgagagttgggaatctggaaccacttctttattatctcaggtcataatgaacttgtaagaattcacagtggcaggaaaccctatgtaaatggaaaatatgggaaaggcttcatttaatccataggactgataccacaaaactcccactaggagaaaacctatgtttatacggaatgtgggaaaatcttcacttatttctcaagccttaaagtgtatgtcaggattcccagtggagagaagccatattgatgtaaggaatgtgggaaagcccttgcctgccacttagtccttgataaacattttagaacacaaactggagagaaactatgaattcaaggattgtgggaaaacccttttatgttccacaagctttaatattcatatgcaatgtatgctggagaataacttgatgactataataagtggaatggcctaggtcagggatccccaaacccctgggccatggactggtactggtctgtggcctgctaggatccagggtgcacagcaggaggtgaatgtaggatgagcaaacattactgcctgagctcaactttctgtcagatcagcagtggcattagattctcataggagcatgaactttattgtgaactgcacatgcaagggatctaggttgcacactccttatgagaatctaatgcctgatgatctgaactggaacagtttaatccccaactccagtccgtgggaaaaatgtcttccacgaaactggtccctggtgccaaaaagttaggggaccactgatttagattatgtcacatgtcccatccactcattaacattaaggctttcatccctgggacctcaagataatggtggtatttagagatgtggttttttaaagaggtgattttaaaatgaggcagttagaatggggccctcattcaatatgactggtttccttataagaagtgaaagagataccagggtagcaggcacagaattttatgtgaagtgaccggaaatggttaccttcaaggcaaagagagattcctggaggagatccttcttttaaggctcattatagaggaaatcatccttatctacactttgatcctggacttccagcctcaaaaattatgagcaaataaatttctgttgtttaagcc

SEQ ID NO: 202477 - DNA, 2375 bp, Homo sapiens
  Payload ID: 19931
  Gene Name: zinc finger protein 426
  Uniprot ID: Q9BUY5
  ENST ID: ENST00000535489
  CDS Start-End: 338-2002
ttgtttgtttacttatttttatttttgtttctttagagatagggtcttgctatgttgcccaggctggtctcaaacttctaggctgaagcagtcctcccaccctggcctcccaaaatgctgggattacaggcatgagctactgccccagccggtgtatatgtttgatggctgatgattaagtactgcttgttgattattgattaataccaacaggaatcccaataaccctgtttaaagaggaatggagattgccactgtccatttagattaatgaggtgtcctgaagtgatggtgacatcaatgaaaggagggttctgacacgttctcacctcgcgggatggcagctgctgatttgtcccatggacattatctttctggggacccagtttgccttcatgaagaaaagacaccagcaggaagaatagtggctgactgcctaacagattgttatcaggattcagtgacctttgacgatgtggctgtggacttcacccaggaggagtggactttactggactcaactcagagaagcctctacagtgacgtgatgctggagaactacaagaacctggccacagtaggaggtcagatcatcaaacccagtctaatctcttggttggaacaagaagagtcaaggacagttcagggaggagttctccaaggatgggaaatgcgacttgaaacccagtggtctatacttcagcaggactttttgaggggtcagacatccattgggatacaattggaaggaaaacacaatggaagggaactctgtgactgtgagcaatgtggagaagtcttcagtgaacactcatgccttaagacgcacgtgagaactcaaagtacagggaacactcatgactgtaatcagtatggaaaagatttccttaccctgtgtgagaaaacctctactggtgagaaactttctgagtttaatcagagtgaaaaaatcttcagcctgacaccaaatattgtataccagagaactagcacacaagaaaagtcatttgaatgtagtcactgtggaaaatccttcattaatgagtcataccttcaggcacatatgagaactcacaatggagaaaaactctacgaatggaggaattatgggccaggttttattgactctacaagcctttctgtgcttatagaaaccctcaatgcaaaaaagccctacaaatgtaaggaatgtggaaaaggctatagatacccagcctacctcagtattcacatgcgaacccacactggggagaaaccatatgaatgtaaggaatgtgggaaagccttcaattattccaactcatttcagatacatggaagaactcacactggagagaaaccctatgtatgtaaggaatgtgggaaagccttcactcagtactcgggccttagtatgcatgtacgatctcacagtggagacaagccctatgaatgtaaggaatgtgggaaatccttccttacatcctcacgccttattcaacatataagaactcacactggagagaagccttttgtatgtgttgaatgtgggaaagcctttgcagtttcctcaaatcttagtggacatttgagaactcacactgaagagaaggcctgtgagtgtaagatatgtgggaaagtatttgggtatccctcatgtcttaataatcacatgcgaacgcacagtgcccagaaaccatacacctgtaaggaatgtgggaaggcttttaactattccacccaccttaaaattcacatgcgaatccacactggagaaaaaccctatgagtgtaaacaatgtggaaaggccttcagtcattccagttcatttcaaatacatgaaaggactcacactggagagaaaccctatgaatgcaaggagtgtgggaaagccttcacgtgttccagttcctttagaattcatgaaaaaactcacacagaagagaaaccctataaatgtcagcaatgcgggaaagcttacagtcatccccgttcacttcgaagacatgaacaaattcactagtgagaaactgtccatgtaataaatgtgggaaagctctcatttgttccagttcactttaaagacatgaatgaactcactctggagagaagaagctgcatgaaaattacttaattcctgtaatcccagcattttgagaggctgaggtgggtggatcacttgaggtcaggagtttgagaccaccctggccaacatggtgaaaccttgtctctactgaaaatacaaaaaatttagccaggtgtggtgggcacctgtaatcccagctacttgggaggctgaggcaagtgaatcacttgaacccaggaagcagaggttgcagtgagcagagatcatgccactgcactccagcctgggcgatggagtgagactccatctc

SEQ ID NO: 202478 - DNA, 919 bp, Homo sapiens
  Payload ID: 19931
  Gene Name: zinc finger protein 426
  ENST ID: ENST00000589289
  CDS Start-End: 255-611
ccaaaggcctccaaagcagcgtttgtgaatttttttccggcaggaaaataattgctgccttttgcatccgcgttggctccgtccccaggatcttcccggttcagggacctggcgatttctgagtgttccggaatcccaataaccctgtttaaagaggaatggagattgccactgtccatttagattaatgaggtgtcctgaagtgatggtgacatcaatgaaaggagggttctgacacgttctcacctcgcgggatggcagctgctgatttgtcccatggacattatctttctggggacccagtttgccttcatgaagaaaagacaccagcaggaagaatagtggctgactgcctaacagattgttatcaggattcagtgacctttgacgatgtggctgtggacttcacccaggaggagtggactttactggactcaactcagagaagcctctacagtgacgtgatgctggagaactacaagaacctggccacagtaggaggtcagatcatcaaacccagtctaatctcttggttggaacaagaagagtcaaggacagttcagggaggagttctccaaggaaggaaaacacaatggaagggaactctgtgactgtgagcaatgtggagaagtcttcagtgaacactcatgccttaagacgcacgtgagaactcaaagtacagggaacactcatgactgtaatcagtatggaaaagatttccttaccctgtgtgagaaaacctctactggtgagaaactttctgagtttaatcagagtgaaaaaatcttcagcctgacaccaaatattgtataccagagaactagcacacaagaaaagtcatttgaatgtagtcactgtggaaaatccttcattaatgagtcataccttcaggcacatatgagaactcacaatggagaaa

SEQ ID NO: 202479 - DNA, 2402 bp, Homo sapiens
  Payload ID: 19931
  Gene Name: zinc finger protein 426
  ENST ID: ENST00000593003
  CDS Start-End: 479-2029
ggcctcactggcctgggtgagttccgaggagatgaactggttttggggtgaaggacgggtttggcccggacgttagagaggcctggcccgctctgctcgtgtctgctgggcccgctagcgtccgctcggaccgtcgctcctcgggaggagtcgggtttatagttacggtgtccgcagggtgttttcatctgtgcgcccctctccaaaggcctccaaagcagcgtttgtgaatttttttccggcaggaaaataattgctgccttttgcatccgcgttggctccgtccccaggatcttcccggttcagggacctggcgatttctgagtgttccggaatcccaataaccctgtttaaagaggaatggagattgccactgtccatttagattaatgaggtgtcctgaagtgatggtgacatcaatgaaaggagggttctgacacgttctcacctcgcgggatggcagctgctgatttgtcccatggattcagtgacctttgacgatgtggctgtggacttcacccaggaggagtggactttactggactcaactcagagaagcctctacagtgacgtgatgctggagaactacaagaacctggccacagtaggaggtcagatcatcaaacccagtctaatctcttggttggaacaagaagagtcaaggacagttcagggaggagttctccaaggatgggaaatgcgacttgaaacccagtggtctatacttcagcaggactttttgaggggtcagacatccattgggatacaattggaaggaaaacacaatggaagggaactctgtgactgtgagcaatgtggagaagtcttcagtgaacactcatgccttaagacgcacgtgagaactcaaagtacagggaacactcatgactgtaatcagtatggaaaagatttccttaccctgtgtgagaaaacctctactggtgagaaactttctgagtttaatcagagtgaaaaaatcttcagcctgacaccaaatattgtataccagagaactagcacacaagaaaagtcatttgaatgtagtcactgtggaaaatccttcattaatgagtcataccttcaggcacatatgagaactcacaatggagaaaaactctacgaatggaggaattatgggccaggttttattgactctacaagcctttctgtgcttatagaaaccctcaatgcaaaaaagccctacaaatgtaaggaatgtggaaaaggctatagatacccagcctacctcagtattcacatgcgaacccacactggggagaaaccatatgaatgtaaggaatgtgggaaagccttcaattattccaactcatttcagatacatggaagaactcacactggagagaaaccctatgtatgtaaggaatgtgggaaagccttcactcagtactcgggccttagtatgcatgtacgatctcacagtggagacaagccctatgaatgtaaggaatgtgggaaatccttccttacatcctcacgccttattcaacatataagaactcacactggagagaagccttttgtatgtgttgaatgtgggaaagcctttgcagtttcctcaaatcttagtggacatttgagaactcacactgaagagaaggcctgtgagtgtaagatatgtgggaaagtatttgggtatccctcatgtcttaataatcacatgcgaacgcacagtgcccagaaaccatacacctgtaaggaatgtgggaaggcttttaactattccacccaccttaaaattcacatgcgaatccacactggagaaaaaccctatgagtgtaaacaatgtggaaaggccttcagtcattccagttcatttcaaatacatgaaaggactcacactggagagaaaccctatgaatgcaaggagtgtgggaaagccttcacgtgttccagttcctttagaattcatgaaaaaactcacacagaagagaaaccctataaatgtcagcaatgcgggaaagcttacagtcatccccgttcacttcgaagacatgaacaaattcactagtgagaaactgtccatgtaataaatgtgggaaagctctcatttgttccagttcactttaaagacatgaatgaactcactctggagagaagaagctgcatgaaaattacttaattcctgtaatcccagcattttgagaggctgaggtgggtggatcacttgaggtcaggagtttgagaccaccctggccaacatggtgaaaccttgtctctactgaaaatacaaaaaatttagccaggtgtggtgggcacctgtaatcccagctacttgggaggctgaggcaagtgaatcacttgaacccaggaagcagaggttgcagtgagcagagatcatgccactgcactccagcctgggcgatggagtgagactccatctc

SEQ ID NO: 202480 - DNA, 1412 bp, Homo sapiens
  Payload ID: 19932
  Gene Name: zinc finger protein 428
  Uniprot ID: Q96B54
  ENST ID: ENST00000300811
  CDS Start-End: 448-1014
cagttttgtaaggcgcgttcctgccccgcacacgcacgcgcgaacccttcagcttcttgttcctttgggccgcgggctgtaccaagtaaacccaggcagcgaggggcaaagcacggcgccccccgcgcgggtctcgtcgacggcccgacgcgcatagcccctcttcccacagcgctacaggactagtccgtctcgccgcgcaagcgccctaggctcttcacgccccctgcgcgctgtcctaccctacttgcgacgcaggcgcagaggctgggcgtgcagccgccgccgcagagccggagcgggggccgccggcgccgcatccctctctacctgccaacatcctgtattagagaacttgtggccggaggtgtggctgtggagagctggccggggagggacgctgctcagctgctgctctgctcctgtctcctgtcccctcccccggtcatgacagagacccgtgagccagctgagactgggggctacgccagcttggaagaagatgatgaagacctttccccaggccccgagcattcctctgattcagaatacactctctcagagccggactccgaagaggaagaagatgaggaggaggaggaagaggagaccactgacgatcctgaatatgatcctggctacaaggtgaagcagcgccttggcgggggccgtggtggcccatcccgccgggccccccgtgcagcccagcccccggcccagccttgccagctctgtggccgctcaccccttggggaggccccaccgggaaccccaccctgccggctctgctgccctgctacagccccccaggaagcaccagcccctgaaggcagggccctcggggaggaagaggaggaaccacctcgggctggggagggccgaccagctgggcgggaggaggaggaggaagaggaggaggagggaacctaccactgtacggaatgtgaggattccttcgacaacctgggggagctgcacgggcacttcatgctgcatgcccggggtgaggtgtaggcagagcccccatacggggagcttggcagaaggggtggggtgggaggagggggctgaggaaattggggttgtgacagtggtcatgggggatggggtactgccggtctgtgttgtcttagaagtagatgtgtgatggccagaataaaagccaaaatctgtatctgtgtgtgttggttcagagtgtgtgtgtgtgtgtgtgtattcccgcccgtgtgtgtgtttgtgtgtgtgtgtgtgtgtgtgtattccccctgggctccttcttggggaaccttggggtcttttgggaaagataacatttactgcgtgcttgtattcgatgaggtttccatgtatttacttacagaccccataatgtaaaggctctaataatagaattttgtttctcactcacaaaa

SEQ ID NO: 202481 - DNA, 827 bp, Homo sapiens
  Payload ID: 19932
  Gene Name: zinc finger protein 428
  ENST ID: ENST00000598676
  CDS Start-End: 173-827
gcagccgccgccgcagagccggagcgggggccgccggcgccgcatccctctctacctgccaacatcctgtattagagaacttgtggccggaggtgtggctgtggagagctggccggggagggacgctgctcagctgctgctctgctcctgtctcctgtcccctcccccggtcatgacagagacccgtgagccagctgagactgggggctacgccagcttggaagaagatgatgaagacctttccccaggctggaagggagtggcgcaatcatggctcaaatgcagcctggaactcctcggctcaagtgatcctcccgcctcagcctcccgagaagctggtactacaggccccgagcattcctctgattcagaatacactctctcagagccggactccgaagaggaagaagatgaggaggaggaggaagaggagaccactgacgatcctgaatatgatcctggctacaaggtgaagcagcgccttggcgggggccgtggtggcccatcccgccgggccccccgtgcagcccagcccccggcccagccttgccagctctgtggccgctcaccccttggggaggccccaccgggaaccccaccctgccggctctgctgccctgctacagccccccaggaagcaccagcccctgaaggcagggccctcggggaggaagaggaggaaccacctcgggctggggagggccgaccagctgggcgggaggaggaggaggaagaggaggaggagggaacctaccactgtacggaatgtgaggattccttcgacaacctgggggagctgcacgggcacttcatgctgcatgcccggg

SEQ ID NO: 202482 - DNA, 2233 bp, Homo sapiens
  Payload ID: 19933
  Gene Name: zinc finger protein 429
  Uniprot ID: Q86V71
  ENST ID: ENST00000358491
  CDS Start-End: 209-2233
aaacattatccaatcaggcacgcagctggagcgacaggacggtttccggaatatggcggggcgtttggctcttgctgcagccagagctccaggtctcgtcttcatttctgtgtcctttgttcttagaggcccagcctgtgtggccctgtgacccgcagatattgggagatacacagctaagactccaggaccccctggaagcctagaaatgggaccattgacatttacagatgtggccatagaattctctctggaggagtggcagtgcctggacacagcacaacagaacttatatagaaatgtgatgttagagaactacagaaacttggtcttcctgggtattgctgtttctaagccagacctaatcacttgtctagagaaagaaaaagaaccctgcaagatgaagcgacatgaaatggtggatgaacccccagttgtgtgttctcattttgctgaagacttttggccagagcaagacataaaagattctttccaaaaagtgacactgaggagatatgataaacgtggacatgagaacttacaattaagaaaaggctataaaactgtaggtgattgtaagctatacaaaggaggttataatggacttaaccaatgtttgacacttacccagagcaaaatgtatcactgtgatatatatgtaaaagtcttttatgcattttcaaatgcagatagatacaagacaagacatactggaaagaaacctttccagtgtaaaaaatgtggcaaatcattttgcatgctttcacaactaactcaacataagaaaattcatattagagagaatacctacagatgtaaagaatttggcaatgcctttaatcagtcctcagcccttactaaccataagagaatttatgttggtgagaaacactacagatgtgaagaatgtggcaaagcatttaaccactactcaacccttactaaccataagagaattcatactggagagaaaccctacaaatgtaaagaatgtggcaaagcctttagcaggtactcaacccttactacccataagagaattcattctggagagaagccctacaaatgtgatgaatgtggcaaaacctttagcatatcctcaacctttactaaacataagataattcatactgaagagaaaccctacaaatgtaaagaatgtggcaaagcctttaaccggtcctcaacccttactagccataagagaatacatactggtgagaaaccctacaaatgtgaagaatgtggcaaagcctttaactggtcttcaactcttactaaacataaggtaattcatactggagagaagccctacaaatgtgaagaatgtggcaaagcttttaaccagtcttcaagacttactcgacataaaaaaattcatactggagaggaaccctacaaatttgaaaaatgtggcagagtttttacctgttcctcaacacttactcaagacaagaaaattcatactggagagaaaccctacaattgtgaagaatgtggcaaagtttttacctattcctctacacttactagacataagagaattcatactgaagagaaaccctataaatgtaacgaatgtggcaaagcttttaaccggtcctcacaccttactagccataggagaattcatactggagagaaaccctacaaatgtgaagaatgtggcaaagcctttaagcagtcctcaaaccttaacagtcataaaaaaattcatagtggagagaaaccctacaaatgtgaagaatgtggcaaagcttttatcctgtcctcaagacttactcaacataagaaaattcatactggagagaaaccttacaaatgtgaagaatgtggcaaagcttttaaccggtcctcaagacttactcaacataagaaaattcatactggagagaaaccctacaaatgtaaacaatgtgacaaagcttttacccactcctcaaaccttagtagtcataagaaaattcatagtggagagaaaccctacaaatgtgaagaatgtggcaaagcttttaatcggtcctcaagacttactcaacataagaaaattcatactagagagaaaccttacaaatgtgaagaatgtgccaaagcttttacccggtcttcaagacttactcaacataagaaaattcataggatgggtgtggtggctcatgcctgtaatcccagcactttgggaggcagaggtgggcggatcacgaggtcaggagatcgagaccgtcctggctaa

SEQ ID NO: 202483 - DNA, 1484 bp, Homo sapiens
  Payload ID: 19933
  Gene Name: zinc finger protein 429
  ENST ID: ENST00000594385
  CDS Start-End: 1-281
atggagtttcgctcttgttgcccaggctggagtgcagtggcacgatctctgctcactacaacttccccctaccgggttcaagcgattctcctgcctcagcttcctcagtagttgggattacaggtctgttgcagcttgctagaggtccactccagaccctgttcacctgggaatcacaaatagaggctgtagaatggcaaaaattgcttcctgctccttcctctggaagcttcatcacagaggggcaccagcctgatgccaaccggagctctcctgtatgaggtttctatcgacccctgttgggaagtctctcccagtcaggaggcacaggggtcagggaccaacgtgaggaggcagtctgtcccttagcagagctgacgtgctgtgctgggagaatccctcttgtcagggtcacctgctctcttcagagccagcagtcaggaaggattaaatctatggaagctgtgcccacagcaaccccttcccccaggtgctctgtcccagggagatggggattttgtctgtaagcccctgactggggctgtctcctttccatccgagatgccctgcccagcgaggaggaatctagagaagcagtctggccatattttggcagcccacaaatcctcccagcctccttagcactagaaaactgcctactaaagcctcagtaatgggggatgcccctccccccaccaagctcgatcatcccaactcaacttcagactgctgtgctgtcagtgagaatttcaagccagtggttcttagcttgctgagcttcatgggattgggacctgctgagcgagaccacgtggctccctggcttcagcccctttctaggggagtaaagggttctgtcttgctggggttccagatgccactgtggtacaaaacaaacaaacaacaacaacaaagcaaaactcctgcagctagcttggtgtctgcccaaatagccacccagttttgtgcttgaaacccagggctgtgctggtgtaggcacaccagggaatcccctgatctgcagattgcaaaaatcatggggaaaggatagtaacctggccgggtagcacagttcctcacggcttcccttggctgggggagggaggtcccccagctccttgcacttcgtgggtgaagcgatgccccaccctgcttctgctcgccctccatgggttgtacccactgcctaaccagtcccagttggatgaactgggtacctcagttggaaatgcagaaatcacctgtcttctgcatgggtctcgctgggagctgcagactggaaatgtttatttggccctcttgaccctgtcccccaaatcatcttttatttttatttcatccaaatagctgctatcttttttttgtacatctttgcctaaattataataagaacaacgatctaaatttgcatagcaagtggaccctatatttggaatttaaagagtttctggcaaaatttagattaaattggctaattaataaca

SEQ ID NO: 202484 - DNA, 1043 bp, Homo sapiens
  Payload ID: 19933
  Gene Name: zinc finger protein 429
  ENST ID: ENST00000597078
  CDS Start-End: 169-537
ggtttccggaatatggcggggcgtttggctcttgctgcagccagagctccaggtctcgtcttcatttctgtgtcctttgttcttagaggcccagcctgtgtggccctgtgacccgcagatattgggagatacacagctaagactccaggaccccctggaagcctagaaatgggaccattgacatttacagatgtggccatagaattctctctggaggagtggcagtgcctggacacagcacaacagaacttatatagaaatgtgatgttagagaactacagaaacttggtcttcctgggtattgctgtttctaagccagacctaatcacttgtctagagaaagaaaaagaaccctgcaagatgaagcgacatgaaatggtggatgaacccccagatggagtttcgctcttgttgcccaggctggagtgcagtggcacgatctctgctcactacaacttccccctaccgggttcaagcgattctcctgcctcagcttcctcagtagttgggattacaggttggggaacttctggataatatccacatcactttcaggtctgttgcagcttgctagaggtccactccagaccctgttcacctgggaatcacaaatagaggctgtagaatggcaaaaattgcttcctgctccttcctctggaagcttcatcacagaggggcaccagcctgatgccaaccggagctctcctgtatgaggtttctatcgacccctgttgggaagtctctcccagtcaggaggcacaggggtcagggaccaacgtgaggaggcagtctgtcccttagcagagctgacgtgctgtgctgggagaatccctcttgtcagggtcacctgctctcttcagagccagcagtcaggaaggattaaatctatggaagctgtgcccacagcaaccccttcccccaggtgctctgtcccagggagatggggattttgtctgtaagcccctgactggggctgtctcctttccatccgagatgccctgcccagcgaggaggaatctagagaagcagtctggccatatttt

SEQ ID NO: 202485 - DNA, 1889 bp, Homo sapiens
  Payload ID: 19933
  Gene Name: zinc finger protein 429
  ENST ID: ENST00000618549
  CDS Start-End: 112-1869
gtcttcatttctgtgtcctttgttcttagaggcccagcctgtgtggccctgtgacccgcagatattgggagatacacagctaagactccaggaccccctggaagcctagaaatgggaccattgacatttacagatgtggccatagaattctctctggaggagtggcagtgcctggacacagcacaacagaacttatatagaaatgtgatgttagagaactacagaaacttggtcttcctgggtattgctgtttctaagccagacctaatcacttgtctagagaaagaaaaagaaccctgcaagatgaagcgacatgaaatggtggatgaacccccagttgtgtgttctcattttgctgaagacttttggccagagcaagacataaaagattctttccaaaaagtgacactgaggagatatgataaacgtggacatgagaacttacaattaagaaaaggctataaaactgtaggtgattgtaagctatacaaaggaggttataatggacttaaccaatgtttgacacttacccagagcaaaatgtatcactgtgatatatatgtaaaagtcttttatgcattttcaaatgcagatagatacaagacaagacatactggaaagaaacctttccagtgtaaaaaatgtggcaaatcattttgcatgctttcacaactaactcaacataagaaaattcatattagagagaatacctacagatgtaaagaatttggcaatgcctttaatcagtcctcagcccttactaaccataagagaatttatgttggtgagaaacactacagatgtgaagaatgtggcaaagcatttaaccactactcaacccttactaaccataagagaattcattctggagagaagccctacaaatgtgatgaatgtggcaaaacctttagcatatcctcaacctttactaaacataagataattcatactgaagagaaaccctacaaatgtaaagaatgtggcaaagcctttaaccggcctcaacccttactagccataatacatactggtgagaaaccctacaaatgtgaagaatgtgcaaagcctttaactggtcttcaactcactaaacataaggtaattcatactggagagaagccctacaaatgtgaagaatgtggcaaagcttttaaccagtcttcaagacttactcgacataaaaaaattcatactggagaggaaccctacaaatttgaaaaatgtggcagagtttttacctgttcctcaacacttactcaagacaagaaaattcatactggagagaaaccctacaattgtgaagaatgtggcaaagtttttacctattcctctacacttactagacataagagaattcatactgaagagaaaccctataaatgtaacgaatgtggcaaagcttttaaccggtcctcacaccttactagccataggagaattcatactggagagaaaccctacaaatgtgaagaatgtggcaaagcctttaagcagtcctcaaaccttaacagtcataaaaaaattcatagtggagagaaaccctacaaatgtgaagaatgtggcaaagcttttatcctgtcctcaagacttactcaacataagaaaattcatactggagagaaaccttacaaatgtgaagaatgtggcaaagcttttaaccggtcctcaagacttactcaacataagaaaattcatactggagagaaaccctacaaatgtaaacaatgtgacaaagcttttacccactcctcaaaccttagtagtcataagaaaattcatagtggagagaaaccctacaaatgtgaagaatgtggcaaagcttttaatcggtcctcaagacttactcaacataagaaagaaaattcatagagagaaaccttacaaatgtg

SEQ ID NO: 202486 - DNA, 2881 bp, Homo sapiens
  Payload ID: 19934
  Gene Name: zinc finger protein 43
  Uniprot ID: P17038
  ENST ID: ENST00000354959
  CDS Start-End: 171-2600
ggcttccgggatgtggcggggcctttgtctctggctgcagttggagctctgcgtctcgtcttcgttcttctgtgtcctctgctgctagaggtccagcctctgtggctctgtgacctgcgggtattgggggatccacagctaagacgccaggaccccccggaagcctagaaatgggaccattgacatttatggatgtggccatagaattctgtctggaggagtggcaatgcctggacattgcacagcagaatttatataggaatgtgatgttagagaactacagaaacctggtcttcctgggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcctttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcgtaccttattgcacaggaaagaatttttacttggaaaaaggtatatacacaaagaatgtggaaaagccattaatatgtgctcatatcttactcaacatcagagagtctgtacttaataaaaccattatagatgcaa

SEQ ID NO: 202487 - DNA, 5249 bp, Homo sapiens
  Payload ID: 19934
  Gene Name: zinc finger protein 43
  ENST ID: ENST00000357491
  CDS Start-End: 135-2591
tttgtctccagctcccgctagaccttgggacccgcctctgcttttccgcgttctccaactcgggaatccccggtgactttgtcgcagcctccgttaccctgtgatctgcaagtcctgggagacgcacagctaagatgcccggacatcctggaagctgggaaatgggaccattgacatttatggatgtggccatagaattctgtctggaggagtggcaatgcctggacattgcacagcagaatttatataggaatgtgatgttagagaactacagaaacctggtcttcctgggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcctttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcgtaccttattgcacaggaaagaatttttacttggaaaaaggtatatacacaaagaatgtggaaaagccattaatatgtgctcatatcttactcaacatcagagagtctgtacttaataaaaccattatagatgcaactagtgtcaaaagatctttcagaaaataaaagcctttaaagtgaagaagataattcattctgaagacaaacattacaaatattaagagggttgtagtaccattacttgcatcacagatcttattgtacacattttgtactaaagaaaaccctgaagcagttgctcaaatactgttcaacatcagaaaatttatattggaaaaaacccctggaaaatgtaataaatttgtaaaaacagttttgaaaaactacagcttataaaacatgagggtctataatgcttggttgatagtacaaagtttattcaacatcagggaatttatattggagaaaaaccctacaaatgtaatcagtttggaaaaacatttttaaaaaaaccacagcatagaaaacaccacagggttcatactaaaatatgtttttgcagatgcagtaaaaatgaaaaaaatttaatccgaaattaagtttatgtaaatatctgagaattcacagtagaaatatctaaggcgcggacacttcagacattacactaaatcagtgctaagtacagaaaacaacacaaaataaaacttggtggataaattatttgtatataacattaaaagaagtagaagattttcagttataattacaattaaagtatacttttatcttgaaaaaattactgatttttaaattagtgaataatgatgtaattaaactctcaaataactttatgctcttttttcattcctgctatattcacatgtgaaagcatgtgaccaattgttgctgcaccaaagatatgagagattcttttattaggtgggcattatttaaaacattttttatggaacagtaaggatattaaagtgtaagatgcagccaggcatggtggctcatgcctataatcccagcactttgggaggctgaggccggtggatcacctgaggtcaggagtttgagaccagcctgaccaacatggtgaaaccctgtctttactaaaaatacaaaaatttaccaggcacctataatcccagctacttcaaaggctgaagcaggagaatcacttgaacctggaaagtggaggtctcagtgagccgaaatcataccattgcactccaacctgggcaacaaaagtcaaactccatctcaaaaagaaaaaaaaaaaaaaaaaagatgcgtgatgaaaatgtaactggagaggctctttgtggttaacttataaaggagtgatgcaggagataggttttcagagtaatattcttctgcattatagtgacaaaagttttttattttagttaaaattggttaaattagtaagtcattttacttattgtaattttatgtaattaaatgtacatttttaaatttttagattacatgtaaatataacttttaaaaaaatgtgttaagaccattgtacattcaatgaagcattattatgcttctaactttaacctatttcaccttactcaagagtgtatgtaaaagatggtaacaatatactatttggtaacataatggactaacatttctattaatctatttcaccagtggctttcaactgcaaataagttaaagaatatttttctataggttaaatattcttttttgtcttatttaaacttactgttcttaatttctgtgggtacatagtatgattttaattaccttattttattctttgtgctattcataattttttttgtttgtttggtttttttttttgagacagagtcttgctctcgcccaggctggagtgcagtggcgcgatcttggctcactgcaagctccgcctcccaggttcactccattctcctgcctcagcctcccaagtagctgggaccacaggcgcccactacttgtttgggtttttttttggagatggagtctcgctctgtcacccaggctggagtacagtggcatgatcttggctcactgcaacccccacctccccggttcaagtgattctcctgcctcagcctcccgaatagctgggattacaggcgtccaccatcacaccaggctaatttttgtatttttagtagagatggagtttcaccatgttggccaggatggtctcgatcttctgacctcatgatctgcctgcctcggcctcccagagttctgggaccacaggcatgagccactgcacctggccaaatgtgtatatatttatgcaatatataacatgttttgatacaggcatataatatgtattagtcacatcaggataaagtatctattaccttcagcatttatcctttgtattacaagccaattctacacttcattattttaatgtacaattaaattgttattgactacagggtcattttaattataaaaattatatagaagtataaataaagtccatacattcctgagtcatgaat

SEQ ID NO: 202488 - DNA, 580 bp, Homo sapiens
  Payload ID: 19934
  Gene Name: zinc finger protein 43
  ENST ID: ENST00000599906
  CDS Start-End: 218-580
cctttgtctctggctgcagttggagctctgcgtctcgtcttcgttcttctgtgtcctctgctgctagaggtccagcctctgtggctctgtgacctgcgggtattgggggatccacagctaagacgccaggaccccccggaagcctagaaatggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgctt

SEQ ID NO: 202489 - DNA, 5584 bp, Homo sapiens
  Payload ID: 19934
  Gene Name: zinc finger protein 43
  Uniprot ID: P17038
  ENST ID: ENST00000594012
  CDS Start-End: 516-2927
tctccaactcgggaatccccggtgactttgtcgcagcctccgttaccctgtgatctgcaagtcctgggagacgcacagctaagatgcccggacatcctggaagctgggaaatgacagacccaacatacaggaggtgttgaccctcatacctggaacctggacatgtgtggaatttctaatctcattcctggactttcctgcaggtgatgtgactcttcttcagcctgcaccctgccaaaagaggattgtgatgtatcactggacccagcacctagatgacgtaactctcatcttttgcctggaccttgcatattttgggtgtgattgtgacacatacctctgctcagaatgtgagcgatttgactctcctgcctgggcccagtacacagatgggattgtgacatatcgctggacccagcatgtagatcatgtgaccctatactcttgccttggtgctgtcgcagagggcattgtgacatatcactggtccctgcacccagggaccattgacatttatggatgtggccatagaattctgtctggaggagtggcaatgcctggacattgcacagcagaatttatataggaatgtgatgttagagaactacagaaacctggtcttcctgggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcctttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcgtaccttattgcacaggaaagaatttttacttggaaaaaggtatatacacaaagaatgtggaaaagccattaatatgtgctcatatcttactcaacatcagagagtctgtacttaataaaaccattatagatgcaactagtgtcaaaagatctttcagaaaataaaagcctttaaagtgaagaagataattcattctgaagacaaacattacaaatattaagagggttgtagtaccattacttgcatcacagatcttattgtacacattttgtactaaagaaaaccctgaagcagttgctcaaatactgttcaacatcagaaaatttatattggaaaaaacccctggaaaatgtaataaatttgtaaaaacagttttgaaaaactacagcttataaaacatgagggtctataatgcttggttgatagtacaaagtttattcaacatcagggaatttatattggagaaaaaccctacaaatgtaatcagtttggaaaaacatttttaaaaaaaccacagcatagaaaacaccacagggttcatactaaaatatgtttttgcagatgcagtaaaaatgaaaaaaatttaatccgaaattaagtttatgtaaatatctgagaattcacagtagaaatatctaaggcgcggacacttcagacattacactaaatcagtgctaagtacagaaaacaacacaaaataaaacttggtggataaattatttgtatataacattaaaagaagtagaagattttcagttataattacaattaaagtatacttttatcttgaaaaaattactgatttttaaattagtgaataatgatgtaattaaactctcaaataactttatgctcttttttcattcctgctatattcacatgtgaaagcatgtgaccaattgttgctgcaccaaagatatgagagattcttttattaggtgggcattatttaaaacattttttatggaacagtaaggatattaaagtgtaagatgcagccaggcatggtggctcatgcctataatcccagcactttgggaggctgaggccggtggatcacctgaggtcaggagtttgagaccagcctgaccaacatggtgaaaccctgtctttactaaaaatacaaaaatttaccaggcacctataatcccagctacttcaaaggctgaagcaggagaatcacttgaacctggaaagtggaggtctcagtgagccgaaatcataccattgcactccaacctgggcaacaaaagtcaaactccatctcaaaaagaaaaaaaaaaaaaaaaaagatgcgtgatgaaaatgtaactggagaggctctttgtggttaacttataaaggagtgatgcaggagataggttttcagagtaatattcttctgcattatagtgacaaaagttttttattttagttaaaattggttaaattagtaagtcattttacttattgtaattttatgtaattaaatgtacatttttaaatttttagattacatgtaaatataacttttaaaaaaatgtgttaagaccattgtacattcaatgaagcattattatgcttctaactttaacctatttcaccttactcaagagtgtatgtaaaagatggtaacaatatactatttggtaacataatggactaacatttctattaatctatttcaccagtggctttcaactgcaaataagttaaagaatatttttctataggttaaatattcttttttgtcttatttaaacttactgttcttaatttctgtgggtacatagtatgattttaattaccttattttattctttgtgctattcataattttttttgtttgtttggtttttttttttgagacagagtcttgctctcgcccaggctggagtgcagtggcgcgatcttggctcactgcaagctccgcctcccaggttcactccattctcctgcctcagcctcccaagtagctgggaccacaggcgcccactacttgtttgggtttttttttggagatggagtctcgctctgtcacccaggctggagtacagtggcatgatcttggctcactgcaacccccacctccccggttcaagtgattctcctgcctcagcctcccgaatagctgggattacaggcgtccaccatcacaccaggctaatttttgtatttttagtagagatggagtttcaccatgttggccaggatggtctcgatcttctgacctcatgatctgcctgcctcggcctcccagagttctgggaccacaggcatgagccactgcacctggccaaatgtgtatatatttatgcaatatataacatgttttgatacaggcatataatatgtattagtcacatcaggataaagtatctattaccttcagcatttatcctttgtattacaagccaattctacacttcattattttaatgtacaattaaattgttattgactacagggtcattttaattataaaaattatatagaagtataaataaagtccatacattcctgagtcatgaa

SEQ ID NO: 202490 - DNA, 3399 bp, Homo sapiens
  Payload ID: 19934
  Gene Name: zinc finger protein 43
  Uniprot ID: P17038
  ENST ID: ENST00000595461
  CDS Start-End: 662-3073
cttttccgcgttctccaactcgggaatccccggtgactttgtcgcagcctccgttaccctgtgatctgcaagtcctgggagacgcacagctaagatgcccggacatcctggaagctgggaaatggtgggttggttactctcagaccaagattcagtacacatgtgaggctgtgactgcactgaaaagcacagtccgcagacaaaattgtggctctcttgcaataccgtcaaccattgagattgtgactcacgtacttagacagacccaacatacaggaggtgttgaccctcatacctggaacctggacatgtgtggaatttctaatctcattcctggactttcctgcaggtgatgtgactcttcttcagcctgcaccctgccaaaagaggattgtgatgtatcactggacccagcacctagatgacgtaactctcatcttttgcctggaccttgcatattttgggtgtgattgtgacacatacctctgctcagaatgtgagcgatttgactctcctgcctgggcccagtacacagatgggattgtgacatatcgctggacccagcatgtagatcatgtgaccctatactcttgccttggtgctgtcgcagagggcattgtgacatatcactggtccctgcacccagggaccattgacatttatggatgtggccatagaattctgtctggaggagtggcaatgcctggacattgcacagcagaatttatataggaatgtgatgttagagaactacagaaacctggtcttcctgggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcctttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcgtaccttattgcacaggaaagaatttttacttggaaaaaggtatatacacaaagaatgtggaaaagccattaatatgtgctcatatcttactcaacatcagagagtctgtacttaataaaaccattatagatgcaactagtgtcaaaagatctttcagaaaataaaagcctttaaagtgaa

SEQ ID NO: 202491 - DNA, 3004 bp, Homo sapiens
  Payload ID: 19934
  Gene Name: zinc finger protein 43
  Uniprot ID: P17038
  ENST ID: ENST00000598381
  CDS Start-End: 339-2750
gtgatctgcaagtcctgggagacgcacagctaagatgcccggacatcctggaagctgggaaatggtgatgtgactcttcttcagcctgcaccctgccaaaagaggattgtgatgtatcactggacccagcacctagatgacgtgtgattgtgacacatacctctgctcagaatgtgagcgatttgactctcctgcctgggcccagtacacagatgggattgtgacatatcgctggacccagcatgtagatcatgtgaccctatactcttgccttggtgctgtcgcagagggcattgtgacatatcactggtccctgcacccagggaccattgacatttatggatgtggccatagaattctgtctggaggagtggcaatgcctggacattgcacagcagaatttatataggaatgtgatgttagagaactacagaaacctggtcttcctgggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcctttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcgtaccttattgcacaggaaagaatttttacttggaaaaaggtatatacacaaagaatgtggaaaagccattaatatgtgctcatatcttactcaacatcagagagtctg

SEQ ID NO: 202492 - DNA, 447 bp, Homo sapiens
  Payload ID: 19934
  Gene Name: zinc finger protein 43
  ENST ID: ENST00000596899
  CDS Start-End: 287-447
acccaatcagacgcgcagttggagagggggccgtggcttccggcttttggcggggcctttgtctccagctcccgctagaccttgggacccgcctctgcttttccgcgttctccaactcgggaatccccggtgactttgtcgcagcctccgttaccctgtgatctgcaagtcctgggagacgcacagctaagatgcccggacatcctggaagctgggaaatggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataa

SEQ ID NO: 202493 - DNA, 474 bp, Homo sapiens
  Payload ID: 19934
  Gene Name: zinc finger protein 43
  ENST ID: ENST00000593551
  CDS Start-End: 294-474
tccttgctggatcctgcttgcaggaagcattataatctatctgcatccatcacccaagtaatgtgactctctttctaccaggttgctgcttacagaaagaattgttacctatcactgggccagcacctagctgttgtgatgcttctttttctacctacattcagctcacaatgtagattttgacatactgctgggctaaacaccaaaaatgaagttacgtttttcctcagcactttcctcatcaggcattgtgacatattgtttggcccagaactaagggaccattgacatttatggatgtggccatagaattctgtctggaggagtggcaatgcctggacattgcacagcagaatttatataggaatgtgatgttagagaactacagaaacctggtcttcctgggtattgctgtctctaagccagacctgatcacctgtctggagcaagaaaaagagccttgggagcctatga

SEQ ID NO: 202494 - DNA, 560 bp, Homo sapiens
  Payload ID: 19934
  Gene Name: zinc finger protein 43
  ENST ID: ENST00000598288
  CDS Start-End: 306-560
aacagagaagattacgacaaatttctaagtgcagtgtatcttgtttatcttgtgctgacctcctatctcatcctgtgactaagaatgcctaacctggggaggcagccaaatatgcaggttcactgagccagactaaattgtattcagttgaatgcttatcaaggactcaagaatccagacttttatctcttatttacttatgacctggaagccctcacctcaagttgtcctgcattactggatcaaaccaagaaagagagagaggaaggaggaggtggagaaggaaaaagggaccattgacatttatggatgtggccatagaattctgtctggaggagtggcaatgcctggacattgcacagcagaatttatataggaatgtgatgttagagaactacagaaacctggtcttcctgggtattgctgtctctaagccagacctgatcacctgtctggagcaagaaaaagagccttgggagcctatgaggagacatgaaatggtagccaaacccccaggaggcattgtctctctattgaatgttttctttgatgtacagtaa

SEQ ID NO: 202495 - DNA, 1680 bp, Homo sapiens
  Payload ID: 19934
  Gene Name: zinc finger protein 43
  ENST ID: ENST00000623648
  CDS Start-End: 1-1426
tcatactggagagaaaccctacacatgtgaagaatgtggcaaagcctttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcgtaccttattgcacaggaaagaatttttacttggaaaaaggtatatacacaaagaatgtggaaaagccattaatatgtgctcatatcttactcaacatcagagagtctg

SEQ ID NO: 202496 - DNA, 1707 bp, Homo sapiens
  Payload ID: 19934
  Gene Name: zinc finger protein 43
  ENST ID: ENST00000624732
  CDS Start-End: 1-1426
tcatactggagagaaaccctacacatgtgaagaatgtggcaaagcctttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcgtaccttattgcacaggaaagaatttttacttggaaaaaggtatatacacaaagaatgtggaaaagccattaatatgtgctcatatcttactcaacatcagagagtctgtacttaataaaaccattatagatgcaa

SEQ ID NO: 202497 - DNA, 4083 bp, Homo sapiens
  Payload ID: 19934
  Gene Name: zinc finger protein 43
  ENST ID: ENST00000624335
  CDS Start-End: 1-1426
tcatactggagagaaaccctacacatgtgaagaatgtggcaaagcctttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcgtaccttattgcacaggaaagaatttttacttggaaaaaggtatatacacaaagaatgtggaaaagccattaatatgtgctcatatcttactcaacatcagagagtctgtacttaataaaaccattatagatgcaactagtgtcaaaagatctttcagaaaataaaagcctttaaagtgaagaagataattcattctgaagacaaacattacaaatattaagagggttgtagtaccattacttgcatcacagatcttattgtacacattttgtactaaagaaaaccctgaagcagttgctcaaatactgttcaacatcagaaaatttatattggaaaaaacccctggaaaatgtaataaatttgtaaaaacagttttgaaaaactacagcttataaaacatgagggtctataatgcttggttgatagtacaaagtttattcaacatcagggaatttatattggagaaaaaccctacaaatgtaatcagtttggaaaaacatttttaaaaaaaccacagcatagaaaacaccacagggttcatactaaaatatgtttttgcagatgcagtaaaaatgaaaaaaatttaatccgaaattaagtttatgtaaatatctgagaattcacagtagaaatatctaaggcgcggacacttcagacattacactaaatcagtgctaagtacagaaaacaacacaaaataaaacttggtggataaattatttgtatataacattaaaagaagtagaagattttcagttataattacaattaaagtatacttttatcttgaaaaaattactgatttttaaattagtgaataatgatgtaattaaactctcaaataactttatgctcttttttcattcctgctatattcacatgtgaaagcatgtgaccaattgttgctgcaccaaagatatgagagattcttttattaggtgggcattatttaaaacattttttatggaacagtaaggatattaaagtgtaagatgcagccaggcatggtggctcatgcctataatcccagcactttgggaggctgaggccggtggatcacctgaggtcaggagtttgagaccagcctgaccaacatggtgaaaccctgtctttactaaaaatacaaaaatttaccaggcacctataatcccagctacttcaaaggctgaagcaggagaatcacttgaacctggaaagtggaggtctcagtgagccgaaatcataccattgcactccaacctgggcaacaaaagtcaaactccatctcaaaaagaaaaaaaaaaaaaaaaaagatgcgtgatgaaaatgtaactggagaggctctttgtggttaacttataaaggagtgatgcaggagataggttttcagagtaatattcttctgcattatagtgacaaaagttttttattttagttaaaattggttaaattagtaagtcattttacttattgtaattttatgtaattaaatgtacatttttaaatttttagattacatgtaaatataacttttaaaaaaatgtgttaagaccattgtacattcaatgaagcattattatgcttctaactttaacctatttcaccttactcaagagtgtatgtaaaagatggtaacaatatactatttggtaacataatggactaacatttctattaatctatttcaccagtggctttcaactgcaaataagttaaagaatatttttctataggttaaatattcttttttgtcttatttaaacttactgttcttaatttctgtgggtacatagtatgattttaattaccttattttattctttgtgctattcataattttttttgtttgtttggtttttttttttgagacagagtcttgctctcgcccaggctggagtgcagtggcgcgatcttggctcactgcaagctccgcctcccaggttcactccattctcctgcctcagcctcccaagtagctgggaccacaggcgcccactacttgtttgggtttttttttggagatggagtctcgctctgtcacccaggctggagtacagtggcatgatcttggctcactgcaacccccacctccccggttcaagtgattctcctgcctcagcctcccgaatagctgggattacaggcgtccaccatcacaccaggctaatttttgtatttttagtagagatggagtttcaccatgttggccaggatggtctcgatcttctgacctcatgatctgcctgcctcggcctcccagagttctgggaccacaggcatgagccactgcacctggccaaatgtgtatatatttatgcaatatataacatgttttgatacaggcatataatatgtattagtcacatcaggataaagtatctattaccttcagcatttatcctttgtattacaagccaattctacacttcattattttaatgtacaattaaattgttattgactacagggtcattttaattataaaaattatatagaagtataaataaagtccatacattcctgagtcatgaa

SEQ ID NO: 202498 - DNA, 1752 bp, Homo sapiens
  Payload ID: 19934
  Gene Name: zinc finger protein 43
  ENST ID: ENST00000623359
  CDS Start-End: 1-1426
tcatactggagagaaaccctacacatgtgaagaatgtggcaaagcctttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcgtaccttattgcacaggaaagaatttttacttggaaaaaggtatatacacaaagaatgtggaaaagccattaatatgtgctcatatcttactcaacatcagagagtctgtacttaataaaaccattatagatgcaactagtgtcaaaagatctttcagaaaataaaagcctttaaagtgaa

SEQ ID NO: 202499 - DNA, 3923 bp, Homo sapiens
  Payload ID: 19935
  Gene Name: zinc finger protein 430
  Uniprot ID: Q9H8G1
  ENST ID: ENST00000261560
  CDS Start-End: 182-1894
agcggacagggcggcttccgggtttggcggggcctttgtccctcgctgtggcctgagctccaggtctcgtcttcagcgctctgtgtcctctgctcctagaggtccaggctctgtggccctgtgacccgcaggtattgggagatctacagctaagacgccaggaacccctggaagcctagaaatggagaacctgaagtctggagtgtatcctctcaaggaagcaagtggatgccctggggctgacaggaatcttctggtgtactctttttatgaaaaggggccattgacatttagggatgtggccatagaattttctctggaggagtggcaatgcctggacactgctcagcaggatttgtatagaaaagtgatgttagagaactacagaaacctggtcttcttggcaggtattgctgtttctaagccagacctgatcacctgtctagagcaaggaaaagagccctggaatatgaagagacatgcgatggtagatcaacccccagttacatattctcattttgcccaagacctttggccagagcagggcataaaagattctttccaagaagtcatattgagaagatatggaaaatgtggacatgaagatttacagttaagaacaggctgtaaaagtgtggatgagtgtaatctgcacaaagaatgttatgatgaactaaaccagtgtttgacaactacccagagtgaaatatttcaatatgataaatatgtgaatgtcttttataaattttcaaatccaaatatacaaaagataagacatactggaaagaagcctttcaaatgtaaaaaatgtgacaaatcgttttgcatgcttttacacctaactcaacataaaagaattcatattagggaaaattcttaccaatgtgaagaatgtggtaaagtctttaactggttctcaacccttactagacacagaagaattcatactggagagaaaccctacaaatgtgaacaatgtggcaaagcttttaagcagtcctcaacccttactacacataagataattcatactggagagaaaccctacagatgtgaagaatgtggcaaaacctttaaccggtcctcacaccttactacacataaaagaattcatactggagagaaaccctacagatgtgaagaatgtggcagagcttttaaccggtcctcacaccttactacacataagattattcatactggagagaaaccctacaaatgtgaagaatgtggcaaagcttttaaccaatcctcaacccttactacacataagataattcatgctggagagaaaccttacaaatgtgaagaatgtggcaaagctttttaccgattctcataccttactaaacataagataattcatactggagagaaattctacaaatgtgaagaatgtggcaaaggctttaattggtcctcgacccttactaaacataaaagaattcatactggagagaaaccctacaaatgtgaacaatgtggcaaagcttttaatgagtcctcaaaccttactgcacataagataattcatactggagagaaaccctacaaatgtgaagaatgtggcaaagcctttaaccggtccccaaaacttactgcacataaggtaattcattctggagagaaaccctacaaatgtgaagaatgtggcaaagcttttaaccaattctcaaaccttactaaacataagataactcatattggagatacatcttacaaatacctagaatgtgataaagcctttagccagtcttcaactcttactaaacataaggtaattcatactggagagaaaccctacaactgtgaagaatacggcaaagctttcaaccagtcctcaaaccttattgaacaaagtaattcatactggagagaaaccctacaaatgtgaagattgtggcaaagcctctaacccgtcctgaattcttactaaacataagaacattcatactgaagaggaaccctatgagtgtgaagaatatggcaaagccttcaacaagtcctcaattcttaccagacataagataattctggctgggtgcggtggctcacacctgtaatcccagcactttgggaggctgagacgggtgaattacatgaggttgggagttcgagaccagcctgaccaacatggtgaaatcctgtctctactaaaaatacaaaattagccatgcgtagtggtgcatgcctgtaatcccagctactcgggaggctgaggcaggagaattgcttgaacccgggaggcagaggttgaagtgagctgagatcgcgccattgcactccagcctgggcaacaagagtggcactccatctcagaaaaaaaaaaaaaagataattcatactgaaaagaaactctacaaacttgaaagatgtgacagtgcttttgacaacacctaaaacttttaaacataaaaaatcatactggtgagaaatcctagaaatgtaaagaatgtgacaaggcctttaaatggttgtcacacttcattataggtaagatagttcatactgaagaaaacttctacaagtgtgaacagtgtggcaaaacttttaatgaatgctcacaccttattgcacaggagagcatttatacttgaaaaaaattgtacaaatataaagaccatgaaaaagccattaatatctattcacatcttaccactggagagttcatacttaataaaaggaatataagtgcaattactgtcaaaagatctttcagaaaatataaacctttaaagcgaagaaggtatttattttgaagatgaacactacaaatgtgaagagggttgtagtacctttatttgtatcacagattttattgtacacattttgtactagaagaaaactctgaagtagttgctcaaactttgttcaacatcagggaatttatattgaagaaaaactttgcaaatttaataaattttaaaaaacactttttcaaaaagtacagcttagaagacaccagagttcatactaaaatatatttttgcagatgcagtaaaaatgaaaatatttaatccaaaattaagtctatgtaaatatcagagaatttactgtagaaatatataaggcactgagacttcagatattatactaaatcagagtgctgagtatagaaaataaaactgaagttggggccaggtgcagtggctcacacctgtaatccagcactttgggaggccgagaagggtggatcacctgaggtcaggagtttgagaccagcctgactaacatggagaaaacacggctctactaaaaatacaaaattagccagctgtggtggtgtatgcctgtaatcacagctactcgagaggctgaggcaggagaattgcttgaacccgggaggtggagagtgcagtgaactgaaattgcgccattgcactccagcctgggcaacaagagtgaaactccatttcaaaaaaaaaaaaaaaaaaacaactaaagttggtagaaaaattatttgtatataactttaaaaggagtagaagggctttttgcagagttattacgtttgaagtatactttatttcttgaaaaaattacagattttttgtaaataatgatgtaattcaactctcaaaatatttcctactgtttctttattccagttgtattcacatgtgaaagcatgtgatcagttattgctgcattaaaaacatgagtcttttttattaggtggccattatttatgatcttttctatgaaagagtaaggacattaaaatgtaagatgcatgatgaaaaattaagtgaagaggctctttatggttaatttatattgaataatgcattaggtaggtgttcagagtaatattttgcgttgtgagaacatttttaattttatttaaaattaaatgaaaataaattagtatattattgtactaattgtacttttgtataataaaatccagtgtattttaaaaa

SEQ ID NO: 202500 - DNA, 3021 bp, Homo sapiens
  Payload ID: 19935
  Gene Name: zinc finger protein 430
  ENST ID: ENST00000595401
  CDS Start-End: 85-411
agaggtccaggctctgtggccctgtgacccgcaggtattgggagatctacagctaagacgccaggaacccctggaagcctagaaatggagaacctgaagtctggagtgtatcctctcaaggaagcaagtggatgccctggggctgacaggaatcttctggtgtactctttttatgaaaaggggccattgacatttagggatgtggccatagaattttctctggaggagtggcaatgcctggacactgctcagcaggatttgtatagaaaagtgatgttagagaactacagaaacctggtcttcttgggtattgctgtttctaagccagacctgatcacctgtctagagcaaggaaaagagccctggaatatgaagagacatgcgatggtagatcaacccccaggtaggtgagagtgaacacaacagacgacatgaatgagaggtccaaaaaagaagaaagccaatgcttaaaatgttatttgagaatctgtgttccaaagcaaatattttctgggaagcctgagtttttttttttaattttgccctcgcatagggtcatcttctgtcttatgcttttaaattcaaggattctttccccttggtgatctcccttcaagtttgctatcagaaccaaagtcctcttcatggcatgcgagactcacaatctgactgcttttccattgttttgggggacacacaaatatctacatgattttgagaaactctatgttaaactattttcttttcttttttctttctttttttttttttttgagactgagtttcatgctcgttgcccaggctaaagtgcaatggcacgatctaggctcactgcaacctctgcctcctggattcaagcaattctcctgcctcagcctcctgagtaggtggaattacaggcacctgccaccatgcccagttaattttttgtatttttagtagagacagggtttcaccatgttgggcaggctggtctcaaactcctgacctcaagtgatccacccgccttggcctcccaaagtactaggattacaggtgtgagccactgcacctggccaaactattttcttagttctctttttgcatcatgtctgaaatgtgtaatagtagtggtttctgttccactgttttttgttgttgttgttaacttttctgcacactccattctgttcttattactatattctcgaaatatagtttgaaattataaagcatcatgtctttctactttgttctttttcctcacgattgctttggctatttgaagtttattgttgtttcttgtaaattttagaattgtattttccattactgtgaagaaaaatgccactgaaattttgatagggaatttattgaatctatagattacttagataataggacactttaacaatatttattttttcaatctgtagacatgcaatatttttaaatttgtgtcttctctaatttcttttattaataacatatctttcgttgtaaagattttttacttccttgttctcagaaatttatcattttaatgctattttaaattgttttctttctctgttaaagtgtatggaacaataacttcatacttgtgtgttaattttatgttttgctaatttactgagtgtattaattcagacaaatttcaatgtagtgttcatggttttttatatataaaatcatatgatccacaaacagcaactttttacttgtgttcaatttcagtggctttttaaaaatgtttttgactcattattctgccacatacttccagtgctatgttaaaatagaagcattgacaatgggcacaatgtagttttgcattagtgtctgtgaatttgaaggagcaaacaactcctcaagcttctataaactggtttcagtaggtaaagatctttttctgtcatgtctccagggtcatagaatgctctctgggtttgtagtggagagggggtgtagcttggtcacaaggctgctgggtctgcactagggtccacctttagttggcttgttacaggggcttgggtagtggtaattcccattttatttttggacagactgaatatccttcaacactttgatctgtagagcagacaatagggcaggtttctgcagtcaggttcatatataatggtccttatatcaggatgtgaatgagtatggcgtttattgagtaccggagaggattactgtagttatgcagacaaattcttttttaatggtatatcagtgttgcacagcagattttatgagtaaatatgtcacttactattactgcgcagtttcatatcagtgttttgttagtgtaggtttcttaacattgagttattgtgtttttttgtttcacttttgtattataattttagacagtttgcaattcggtttatctcttataattaagagataaatcagccatatgtctgtcacaattagatatatatgtgtgtgtgtgtttatctataaatatgaccccaatattggttatggcttatcttgtatatattctttcttagccaattttcagtggttgttttatctcacctaagtgagtagtcatggaaatattttcaccatctcttattttcaccatgtgtttaatgatgatgtttctctcacctttgtgtgagagaaacacttttgtaatttgaaggtaatttttgaaaagatttataaatctgtatttttttcagtttttcctttagaaaaattaattgttgtaaaaacacataatatttaccatcttaaatctatttaggtgtaccttttagggccagacatggtggtggctcacatctgtaatccaggattatttgagctcaaaagtttgagaccaacctgggaaacatatggagagtccctctctacaaaatgttttttaaaaatagccaggcatagtgttgtgcatctgtggttcaggctacttgcaagactgaggtgggagggttacttgagcctcagagtttgaggccgaagtgagccataattgtaccactgcactccagctttttgacagagtgagactgtgtctcc

SEQ ID NO: 202501 - DNA, 476 bp, Homo sapiens
  Payload ID: 19935
  Gene Name: zinc finger protein 430
  ENST ID: ENST00000597922
  CDS Start-End: 1-220
ccttactaaacataagataactcatattggagatacatcttacaaatacctagaatgtgataaagcctttagccagtcttcaactcttactaaacataagaacattcatactgaagaggaaccctatgagtgtgaagaatatggcaaagccttcaacaagtcctcaattcttaccagacataagataattctggctgggtgcggtggctcacacctgtaatcccagcactttgggaggctgagacgggtgaattacatgaggttgggagttcgagaccagcctgaccaacatggtgaaatcctgtctctactaaaaatacaaaattagccatgcgtagtggtgcatgcctgtaatcccagctactcgggaggctgaggcaggagaattgcttgaacccgggaggcagaggttgaagtgagctgagatcgcgccattgcactccagcctgggcaacaagagtggcactccatctcag

SEQ ID NO: 202502 - DNA, 595 bp, Homo sapiens
  Payload ID: 19935
  Gene Name: zinc finger protein 430
  ENST ID: ENST00000599548
  CDS Start-End: 168-509
cttccgggtttggcggggcctttgtccctcgctgtggcctgagctccaggtctcgtcttcagcgctctgtgtcctctgctcctagaggtccaggctctgtggccctgtgacccgcaggtattgggagatctacagctaagacgccaggaacccctggaagcctagaaatggagaacctgaagtctggagtgtatcctctcaaggaagcaagtggatgccctggggctgacaggaatcttctggtgtactctttttatgaaaaggggccattgacatttagggatgtggccatagaattttctctggaggagtggcaatgcctggacactgctcagcaggatttgtatagaaaagtgatgttagagaactacagaaacctggtcttcttggcaggtattgctgtttctaagccagacctgatcacctgtctagagcaaggaaaagagccctggaatatgaagagacatgcgatggtagatcaacccccaggctggagtgcaatggcatgatcttggctcgctgaaacttccgccttccaggttcaagtgattctcctgcctcagcctcccgagtagctgggattacaggcaggtac

SEQ ID NO: 202503 - DNA, 536 bp, Homo sapiens
  Payload ID: 19935
  Gene Name: zinc finger protein 430
  ENST ID: ENST00000594110
  CDS Start-End: 152-536
ggcctttgtccctcgctgtggcctgagctccaggtctcgtcttcagcgctctgtgtcctctgctcctagaggtccaggctctgtggccctgtgacccgcaggtattgggagatctacagctaagacgccaggaacccctggaagcctagaaatggagaacctgaagtctggagtgtatcctctcaaggaagcaagtggatgccctggggctgacaggaatcttctggtgtactctttttatgaaaaggggccattgacatttagggatgtggccatagaattttctctggaggagtggcaatgcctggacactgctcagcaggatttgtatagaaaagtgatgttagagaactacagaaacctggtcttcttggcaggtattgctgtttctaagccagacctgatcacctgtctagagcaaggaaaagagccctggaatatgaagagacatgcgatggtagatcaacccccagagtctgtgtttctcagactggatcttggactcctggtctcaagagatctgactgccttggctt

SEQ ID NO: 202504 - DNA, 503 bp, Homo sapiens
  Payload ID: 19935
  Gene Name: zinc finger protein 430
  ENST ID: ENST00000619540
  CDS Start-End: 182-503
agcggacagggcggcttccgggtttggcggggcctttgtccctcgctgtggcctgagctccaggtctcgtcttcagcgctctgtgtcctctgctcctagaggtccaggctctgtggccctgtgacccgcaggtattgggagatctacagctaagacgccaggaacccctggaagcctagaaatggagaacctgaagtctggagtgtatcctctcaaggaagcaagtggatgccctggggctgacaggaatcttctggtgtactctttttatgaaaaggggccattgacatttagggatgtggccatagaattttctctggaggagtggcaatgcctggacactgctcagcaggatttgtatagaaaagtgatgttagagaactacagaaacctggtcttcttggcaggtattgctgtttctaagccagacctgatcacctgtctagagcaaggaaaagagccctggaatatgaagagacatgcgatggtagatcaacccccag

SEQ ID NO: 202505 - DNA, 489 bp, Homo sapiens
  Payload ID: 19935
  Gene Name: zinc finger protein 430
  ENST ID: ENST00000624457
  CDS Start-End: 168-489
cttccgggtttggcggggcctttgtccctcgctgtggcctgagctccaggtctcgtcttcagcgctctgtgtcctctgctcctagaggtccaggctctgtggccctgtgacccgcaggtattgggagatctacagctaagacgccaggaacccctggaagcctagaaatggagaacctgaagtctggagtgtatcctctcaaggaagcaagtggatgccctggggctgacaggaatcttctggtgtactctttttatgaaaaggggccattgacatttagggatgtggccatagaattttctctggaggagtggcaatgcctggacactgctcagcaggatttgtatagaaaagtgatgttagagaactacagaaacctggtcttcttggcaggtattgctgtttctaagccagacctgatcacctgtctagagcaaggaaaagagccctggaatatgaagagacatgcgatggtagatcaacccccag

SEQ ID NO: 202506 - DNA, 3021 bp, Homo sapiens; identical to SEQ ID NO: 202500
  Payload ID: 19935
  Gene Name: zinc finger protein 430
  ENST ID: ENST00000625163
  CDS Start-End: 85-411

SEQ ID NO: 202507 - DNA, 473 bp, Homo sapiens
  Payload ID: 19935
  Gene Name: zinc finger protein 430
  ENST ID: ENST00000623534
  CDS Start-End: 152-473
ggcctttgtccctcgctgtggcctgagctccaggtctcgtcttcagcgctctgtgtcctctgctcctagaggtccaggctctgtggccctgtgacccgcaggtattgggagatctacagctaagacgccaggaacccctggaagcctagaaatggagaacctgaagtctggagtgtatcctctcaaggaagcaagtggatgccctggggctgacaggaatcttctggtgtactctttttatgaaaaggggccattgacatttagggatgtggccatagaattttctctggaggagtggcaatgcctggacactgctcagcaggatttgtatagaaaagtgatgttagagaactacagaaacctggtcttcttggcaggtattgctgtttctaagccagacctgatcacctgtctagagcaaggaaaagagccctggaatatgaagagacatgcgatggtagatcaacccccag

SEQ ID NO: 202508 - DNA, 324 bp, Homo sapiens
  Payload ID: 19935
  Gene Name: zinc finger protein 430
  ENST ID: ENST00000627644
  CDS Start-End: 1-324
gagaacctgaagtctggagtgtatcctctcaaggaagcaagtggatgccctggggctgacaggaatcttctggtgtactctttttatgaaaaggggccattgacatttagggatgtggccatagaattttctctggaggagtggcaatgcctggacactgctcagcaggatttgtatagaaaagtgatgttagagaactacagaaacctggtcttcttgggtattgctgtttctaagccagacctgatcacctgtctagagcaaggaaaagagccctggaatatgaagagacatgcgatggtagatcaacccccaggtaggtga

SEQ ID NO: 202509 - DNA, 13894 bp, Homo sapiens
  Payload ID: 19936
  Gene Name: zinc finger protein 431
  Uniprot ID: Q8TF32
  ENST ID: ENST00000311048
  CDS Start-End: 145-1875
gtctctcgccgcagcctgagctccaggtctccccttcgctgctctgtgtcctctgctcctagaggcccaacatctgtggccctgtgacctgcaggtattgggagacccacagctaagacaccgggaccccctgaaagcctagaaatggacgacttgaaatatggagtgtatcctctcaaggaagcaagtggatgccctggggctgagaggaatcttctagtttactcttattttgaaaaggagacattgacatttagggatgtggccatagaattctctctggaggagtgggaatgcctgaaccctgctcagcagaatttatatatgaatgtgatgttagaaaactacaaaaacctggtcttcttgggtgttgctgtctctaagcaagacccagtcacctgtctggagcaagaaaaagagccctggaatatgaagagacatgagatggtggatgaacccccagctatgtgttcttattttaccaaagacctttggccagagcaagacataaaagattcttttcaacaagtaatactgagaagatatggcaaatgtgaacatgagaatttacagttaagaaaaggctccgcaagtgtagatgagtataaggtgcacaaagaaggttataatgagctaaaccagtgtttgacaactacccagagcaaaatatttccatgtgataaatatgtgaaagtctttcataaatttttaaatgcaaatagacataagacaagacatactggaaagaaacctttcaaatgtaaaaaatgtggcaaatcattttgcatgcttttacacctaagtcaacataaaagaattcatattagagagaattcttaccaatgtgaagaatgtggcaaagcttttaaatggttctcaacccttactagacacaagagaattcatactggagagaaacccttcaaatgtgaagaatgtggcaaagcttttaagcagtcctcaacccttactacacataagataattcatactggggagaaaccatatagatgtgaagaatgtggcaaagccttcaaccggtcctcacaccttactacacataagataattcatactggagagaagccctacaaatgtgaagaatgtggcaaagcttttaaccagtcttcaacccttagtacacataagttcattcatgctggagagaaaccctacaaatgtgaggaatgtgacaaagcttttaatcgattctcataccttactaaacataagataattcatactggagaaaaatcttacaaatgtgaagaatgtggcaaaggctttaattggtcctcaacccttactaaacataaaagaattcatactggagagaaaccctacaaatgtgaagtgtgtggcaaagcctttaatgagtcctcaaaccttactacacataagatgattcatactggagagaaaccctacaaatgtgaagaatgtggcaaagcttttaaccggtccccacaacttactgcacataagataattcatactggagagaaaccttacaaatgtgaagaatgtggcaaagcttttagccagtcatcaatccttactacacataagagaattcacactggagagaaaccctacaaatgtgaagaatgtggcaaagcttttaaccgatcctcaaatcttactaaacataagataattcatacaggagagaaatcttacaaatgtgaagaatgtggtaaagcctttaaccaatcctcaactcttactaaacataggaaaattcatactagacagaaaccctacaactgtgaagaatgtgacaatacatttaaccagtcctcaaaccttattaaacaaaataattcatactggagagaaactctacaaatgtcaagaatgtgggaaagcctttaagcagtcctcaactcttactaagcattaaatattggccgggtgcggtggcttatgcaaaatggctcccagcattttgggaggctgaggtgggtggatcacaaggtcaagagatcgagaccatcctggccaacatggtgaaaccctgtctctactaaaaatacaaaaattatctgggtgtggtggcacgtgcctgtattcccatctactcgggaggcttaggcaggataatcacttgaacctgggaggtggaagttgcagtgagccaagattgtaccactgcactccagtttggcaacagagtgagactccgtctcaaaaaaaatttatactgtacaaaaaccccacaagtgtgaaaaacatggcaaagcctttaagaagccctcaattcttaacagacataagataatttatactggagagaaactctacaaatcagaaagatgtgactacttttgacaacgcctcaaacttttctaaccataaaagtaattatactggtgagaaatcctagaaatctgaagagtgagataaagcctttaaatggttgtcacacttcattgtaggtaagataattcatactggagaaaacgcctacatgtgtgaacaatatggcaaaacttaatgctcacactttattgctaggaaagcatttatacttgagataaattatacaaatataaagactgtgaaaaagccatcattatctgctcacattttactcaacacagagagttcctgcttaataaaagcattataagtgcaattactgtcaaaagatctttcagaaaatataagcttttttagtgaagagtatttattttgaagttgaacatcacaaatataaaaagggttgtagtgcctttacttgtatcacagatctttttgtagacattttcttctagaggaaaactctgaagcagttgatcaaactttgttcaacatcagggaatttatattgaaaaattgtgcaaatataataaatttggaaaaacaatttttcaaaaactacagcttagaaatcaacagttatactagaatatattttttccagatgcagtaaaagtaaaatatttaatccataattaagtctatgcaaatatcagagaatttatggtagaaatatataaggtactgacacttcagatatactaaatcagagtgctaagtatagaaaatctgaaactaaagttggtagaaaagttatttgtatagaactttaagaggatcagaaggttttttgcagagttataattacattcaaagtatactttatttcttgaaaaatattacagattttttgaaaattgaataatgtcatcattcaactctgaaattatttcctgttgtttcttcattcctattggattcacatgtgaaagcatggggttaattgttgctacatcaaagagagagattcttttgtttgtttgttcgtttgttttttgagactgagtttcactctttcgcccaggctggagtgcattggcatgatctcagctcactacaacctctgccttctggtttcaagcaactcttctgcctcagcatcccaagtagctgggataacaggtgccagccaccatgcccagctaatttgtgtatttctagtagagatggggtttcaccatattggccaagctggtcttgaactcctgacctcatgtgatccgcccgcctcagcctcccaaagtgctgggattacaggcttgagccaccacgcccagcctgtagcatattttaataggagaatacaatatataatagtagcagggttaagtaaggcatccatcatctgtagcatttctcctttgttttacaaacaatccaattctacactttaaaaaaaaatttttaaatgtacaattaaatttttatttaccacagtgttatttttatcgtcataataaaaattatatacgagtataaatgaaattcatttctaaattcttaataaatattttctcatgccaggtgtggtggctcacgtctgtaatcccagcactttgacaggctgagcgagggagtggatcttgaggtcagcagttcgagaccagcatggccaatatggagaaatcccgtctctactaaaaatacaaaaattagccaggcgtggtggcatgtgcctgtaatcccagctactcaggaggctgaggcaggagaatcgcttgaacctgggaggtggaggttgcaatgagccaagatcaccccactgcactccagcctgggcaacagagcgagactccatctcaaaaagtaaaatatattttcaaattttctatatatttttctttgaacatgtggcctgtctgcctgcaaacatatacagacttttagttttgattcatatagagttaaatacatgttagtctaaagacaaatcttaggtgtaagaaaattatggagttaagtatgtgtgtgtgagtatgagtttgtacatattttcagaaggaaagaatgatacgggaacaaaaatcattttaatatggtgactactataaaactaaaaacctaaaaaatgctgaaagcaaatgtatactttttggtttgtattgaatttattactgtacagtctatgacttagagttctgaatcttcccaagcaaattctctgtatatacttgcctggtactcatgctagacccatactttttttgtttcttacattttttttgttttatattttatgaagtattcattatgtgagctggtctgcgattataagaatttttatgaaatttagtgcacacaaaataatctttagatgtaattccaaaagtagtgtattaagttacattttatttagttagagcactccattttgttcttttaagaggagaacaatatataggttttctttagtgatttgttcctttcactttttataattgacataagcatatttattgagtcaatttgttcagctaagtactagggaggcttcattagtcatgaggatgtttttatatataaatgtagcaaacatatattacagttttcactgtgtaatagattatccataataattcataaatattcctgctgaagttagtttgtaacttcaagtcaaagatgaaaaatatcaatggtgaagattgattgttcatatagagaggacattttttttccagactgtaaaactgaatcttgttgaatttaaagagaaattctggcagaggcagatgaatcacctgaggtcaggagtttgagaccagcctgatgaatatggtgaaacccagtctctactaaaactacaaaaatagccaggcatggtggtgggtgcctgtaatcccactcgggaggctgagtcaggagaattgcttgaacccggaggtgaagattggagtaagccaagattgtgccgttgcactacagcctgggcgacagagcgagactccatataaaaaaaaaaaaaaaaaaaaaagagctgggcgtggtggctcacgcctgtaatcccagcactttgggaggccaaggtgggcgaatcacttgaggtcgggagtttgagaccaggtgaccaacatggagaaactccatctctactaaaaaatacaaaattagcccggtgtggtggcgcatgcctgtaatcccagctactcgggagactgaggcaggagaatcgcttgaacacgacaggtggaggttgcagtgtggcgagattgcaccattgcactccagtctgggcgacaagagggaaactccatctgaaaaaaaagagaaattcttttattttctacttctcttcagatttgtcttatgcattttccaactatgtatgcatcacagctattctttttctgagttatagctacagttttcttactgttgtcttcatgccatttcatttcacatggtactttgtagattttgatgaggaagttggtatttttagtgcacacaaaaattggttttaactgtagagtttgcttatcagaacagttaaaaggcagccaggtgtggctcacgcctgtaatcccagcactgagataggccaaggagggtggatcacttgaggtcaggagtttgagaccagcctgaccaacatggtgaaaccctgtgtctactaaaaatacaaatttagccacgcgtggtgacgcacgcctgtaatcccagctactcggaaggccgagggagcagaatcgcttgaacctgggaggtagaggttgcggtgagccgagactgggccactgcacttcagcctgggcaacaagagcgaaattctgtctaaaaaaaaaaaaaaaagataaaaggtgcaatactgtccacaggtaagataattaaattagtcagctttgtttttaaaagaaaaatcttactagattcttatacaaagtgtggcaaatataaaacttgcttgaaaatacagaaattaaatttttaagagagttaatggtaagtaaacaattttaaagttaattttctatgatatacttacagcacaacttatatttccatgcagaatcttttatttttaagtgtgagtgttaaaggttacaaaataatgaaatgacttcagtggatttaaaattttgaaaaataatgtcttttctatattgattttacaatttggagaaatttttcactcattttttatatattttttagtgggagaggtttagtctacagtttttatttttagtcaccaaactgtagccaactcttgggtcattttctctgaaaaacatttggagatcatgacagcgtttggattaaaacatttctgttactttgcatgcaaactagtttactgtgttcacagagtggccagtcatgggaccataagcaacacctgctctttgagtgtctttcataccgttaccatcagcaccagaaactccaggtgccccaagcttaaagtaaaaatcctaaagtacgttggctcctcccatgcaatgtgctgggtccaaaccatgctgttaaatatcagaagtttctatggttatgattaaaaaattaaatgacaataatagccccaaaactatatatttttgatactatttaaccaagattatcacaaagacacagtatttgacacattgttattcttctatgttttataaatattttaatgtgacaggtagaatctgtactttttctgtagaacgtaatattttgaagtatatatatagttaaattattatttctaggtaattaataatttatctcacattggtcagacatgatggctcatgcttgtaatcccagcaatttgggaggccgaggcaggcagatcacatgaggtcaggagttcgggaccagcctggcgaccatggggaaaccctgtctctactaaaaatacaaaataagcagcgtgtggtgacacatgcctgtaatccagctaccctggaggctaaggcaggaaaatggctcaaatctgggaggtggttgttgcagggagccgagattgcaccactgcactccagactgggggacagagtgactatcaaaaaaaaaaaaaactttacctcatatggtgaacatttttgttttgagaccacatgacactgtcatcatttttcaaaaatccaaatacattattatgaactatagtcaccatgttgtgcaataaatctcttgaacttatttcttccatttgactataattatgtattatttcacaaacatgtttccagccttccatttcttataaataacttgcatctgatggtcaccattttactctctacatcaatgggattaagttttttggaatccatgtgtaagtgaaattatgagacactaatctttctgtgccttgcttatcccaactaatacaatgtcctccaacttcatccatgtgattgagaataatagtttttgttttttttttaaggccaggagtggtggctcacacctgtaatcccagctctgggaggccaaggccagtggattgcttgagcccaggagtttgagaccagcctggacaacgtggaaaaaccccatctctactaaaaatacaaaaacaacaaaacaaaaacaaaaaacacctcagctgggtgtggtggtgcaggcctgtaatctcagctactccagaggctgaggcatgagaatcccttgaaccacagatgcagaggttgcagtgaactgagatcatgccactgcactccatcctgggcaacagagtgagactcggtctcaagagggaaaataaggcatttttctcatttaaataataaatagtattccattatgtatatcaaccacattgtctttatttactcattagatgttgaactgtttattctgtattttggctattgtgaaacaagtgctgcaaacagaagtgcaaatgtttctttattcttattttgttttggatatatacccagtagtgcgattgctgtattacctggtagtttttttgataaatctgtattttgtttttcgtaatggctatcctcatttacgttcacaccaacagtgtgcaaggattccgttttcttcacatctttaccaacacttttttctttttcttttaataagagttattctaacaggaatgagttgatatagggattttttttttggcttgtctttttgtgataatagtcaacattgagcatttaaaaatatatccgttggacatatgtatgacttttcttgaaaaatatttatttcagctatttccttttttttttttttctttttgagatggagttttgttcttgttgcccaggctggagtgcaatggcacaatctcggctcactgcaacccttgcctcccggatcaagtgattgtcctgcctcagcctctcaagtagctgggattacaggcaaatgccactgcgcccagctaattttgtatttttagtagagacggggtttttctatattggtcaggctggtctcgaacttctgacctctggtgcccacctcagcctcccaaagtgctgagattacaggcatgagccaccgcgtccggcctattatttttaataattttttattgttgtcattttaaatacacttttgatattaacctcttgtcacatgtataatttgcaaattttttctcccatgttctagttgtcacattctgttgattgtatcagattttgtccagcagctttttaatttgaagtgatctgacttatttttccttttgtgtcctgggatgtttaggttaaatcaaaaaacttgcggccaggcgcagtggctcacacctgtaatcccagcactttgggaggccgaggcaggtggatcacgaggtcagaagttcgagaccagcctgaccaacatggtgaaatcctgtctctactaaaaatacaaatattagccgggcgtggttgcacgtgtctataatctcagctactcaggaggctgaggcaggggaacggcttaaacccagaggcggaggttgtagtgagccaaggtcatgccactgcactccagccttggcaacagaatgaaactctgtctcaaaaaaaaaaaaaaatttgctgcccagaacaatgttatagggcttttgctctatattttggcagtagtagtttcagagtgtcaggccttacatttaagtactaatttatttcgagtttatttttacatatggtgtgagatgagggtctcaatttttatctctgcatgtggatataaagttttcttaattgaagattctgttctttccctttaaagtcacctgtatttaaaatcaactgtaaatacatggatatatttctgctgtttttttcttctgctccattgacctatgtctctgtttttattcaagtaccatactgttggttaccatagctatgtagtgtatttcaaagttagtcacttcttttgtcttgattgctttggctattcagggtcttttgtgataccatatgaattttagatatacttttaaaacttttctatgaagtatatcacgtatttcgatagaggttgcattatacctgtaggtcattttgtgtaatacaaatattaatgtcagttcatgaatagtccatttatgtattaatttctatttagaatgtaaggcgtttcaactttttggttaaatttatttcaaactatagttattgtagatgtaattgtttttgaatttcattttgggatagttattaatgtagagaaatgctgtgactttttgatggtgcttttgtattttgaaagtttaataaattttgtttatttatttatttattttgagatggagtctcggtctgtcacgcaggctcgagtgcagtggcacgatcttggctcactgcaacctctgcctccctggctgaagcggttctcctgcctcagcttcctaagtagctgaaactacaggcgcctcctactacacccagctaatttttttatttctatagagatggggtttccctacgttggccagactggtcttgaactcctgaccttgtgatccgcccacctcggcctcccaaagtgctggaattacaggcaggagtcactgcaccttgcctgtttataatttttaagatttactaaggtcttaggcttttttatacttcagattatgtatagggataaaagaaaattatacaggaataattccttttcctcaatttggatgcctttgatttttttctctaatttctttgtcttggatatttagtaccatgtttagtaagtctgactagagtgggcatccttgccttgttctagctcttagagtaaaagcttacaacatatccctgtttagtatgttgttagcagtttttttggttatatatggcatttattggctgaagtgcatttgttctatacctaattttttcagcgatttatcataagggaatgtcaaattctgtcaaacttctattgtgcatccatttttttctctttgcactctgcatatatttaagttttagagatgtgaaatcacaactaattctgcatacatacaaaaaaagtcagagactactatgaacatctctatgcctgcaaaatagaaaatttggagaaaataaataaactcctggaaacatacaactttccaggattaaaccaggaaggaacagaactcttgaacagggcaaaaatgtataaaatatataatgaaattgaattaataatttaaaaaacctaccaactataaggagccctggattatataaaatcacagccgaattttaacacatatacagagatgagctggtattacttctactgaatgtattactgaatgtattccaaaaaatccaggtggagttccaccctaactcattatataaaatctgtatcgctgcacgaggtggctcacgcctgtaatcccagcactttggaaggccgaggtgggcgggtcacctgaggtcgggagtttgagaccagcctgcccaacgtggtgaaaccccatctctgctaaaatacaaaattagccaggcgtggtggcatatgtctgtaatcccagctactcgggaggctgaggcaggaaaatcgcttgaacccgggaggtggaggttgcagtgagccgagatcgcgccattgcactccagcctaggcaatgagtgaaactccatctcaaaataaattaattaataaaataaaaacctgtgtcatcttgataccgaagtctagtgaagacaacaacaacaaaactataggccaatattttgggtgaacattgaaacaaaaatcctccatgaaataatagcaagctgagttcacaggcaaatcaaaaagttattttgccacacttgtgaactttatatcacatgtgcaaggatgtttcatcatatacaagtcaataagtgtgtttcaccatacaattaaaagcaaaaatttatatgattaacacaatagatgcagaaaaagcattcaagaaaatccagtattcatttatgaaaatattctctaagcaatgatgaaacatacctcacaataataagagccatctatgacaaatcctcagctaacatactgaacagacaaaaggggcatgcatttctcattagaaaaaaaataagactatctaaacaattctatttaacatagttctggaagtgctggataaatctaacaaaatgaaaaaataaatggcatccaaataggaaaagaagaagtgaaattaccttcactcatgatataattctctacctagaaaactttaaggattttaccaaaagactcctaaggttaaaaatgacttcagcaaagtctcaggatacaaaattgatatacaaaaatgaatagcattgccttacaccaataacattcaagctgagaacaaaatcaagaacagttttctttacaatagccataaacaaaaaataatatacttagaaatacatcaaaccagggaggtaaaatatctctacaagaactagaaaacattactgaaagtaatcagagacaattcaaataaaaaagctttctatgctcatggatttgaagaatgaatagaaaatgtctatgctgcctagagcagcctacaaaataagtttttgtttttttatcaaaatgtcgattactttttttttttttttgagacagtgttgctctgtggcctaggctggagtgcagtggtgcgatcttggctcactgtaacctccacctcctgggttcaagtgagtctcctacctcagcctcccaagtagctgggattacaggtgcccaccagcacacctggctaatttttatgtttttagtagagatcgagttttgctgtgttggccaggctggtctcaaactcccggcgtcccaaagtgctgggattacaggtgcgacccaccatgcctggcccaaccccatattatttctggtaacaaagcacagaaacatgatttctcgaattttgctaggattttaatttacaaaagaaaggtgaatgccattaaaaggtgtttaatacactcccaccagaaacaagaggcaaggcaggccctgggggcctcacaaaggcggtcttatgcaagggtgagaaagcagagttatcagggaggtgggactattgctttatgaacgtgatgattggaagcaaaaacgtggggctttttcctattgaatacaaagtaaaataatgaatgctggtgtcagtggttgggaataacaacatttgcaggctcatgagagctgcctgacaaaaagcgtgtaaacaacagtgattgctcctgtggccctgtgattcagcaggtttatggagcagttaagaatcgcagatgtcaaatggccaacacagaatctaacgacatgcttaatacaaattattattagtagaaatgctgaattgcttcatttctgcaatttctgctgcttcttaagatgcttttaatgaataaaatctgccttaaaatttgatacctggtaacttctctctgtgagttttgaattggctgatgtaaccaaaatgccagctcttgccatctaactaccattaaaaggaacttctaaagctccgaagtggtcaacagtttcacttccaacttttttaaaagatacacaattttctaaaaaatttttctttatgggcgattgaatagttgggctttggctaattcctcattagcaatagaattatgtatattttgcaaactctaatacagaacacttaatgtatcagacaaccatgattatgatgtatatacctggtataaacaatcttttttgcatattgaattctgcatttttttcttccttgatacgtatgagattcaccagtaccagtttttctcttgtggtggcatatagttgattgtcatttgcattatctattaaaaacctgtggcagctcatggtattattgaccatatgttctagtgtcttcttgcagatttaaatattttattgcagtgtaaagtttaatatttagatgtgtgatacatctttggataatctgtaattaaattgatcttttgtaatggtgatagtgattagcacacactgaaaatccagcaaagcaattatttttctctttttaactggaaatcatattcgtaagttgtggtagatattatcatcagtgtattcatgattcgatttatattttgtgttatctggttataaattttatatagcattcaatttgacaaaatataaatctatttgatttgaa

SEQ ID NO: 202510 - DNA, 610 bp, Homo sapiens
  Payload ID: 19936
  Gene Name: zinc finger protein 431
  ENST ID: ENST00000594425
  CDS Start-End: 148-270
tttgtctctcgccgcagcctgagctccaggtctccccttcgctgctctgtgtcctctgctcctagaggcccaacatctgtggccctgtgacctgcaggtattgggagacccacagctaagacaccgggaccccctgaaagcctagaaatggacgacttgaaatatggagtgtatcctctcaaggaagcaagtggatgccctggggctgagaggaatcttctagtttactcttattttgaaaaggccaggagtggtggctcacacctgtaatcccagctctgggaggccaaggccagtggattgcttgagcccaggagtttgagaccagcctggacaacgtggaaaaaccccatctctactaaaaatacaaaaacaacaaaacaaaaacaaaaaacacctcagctgggtgtggtggtgcaggcctgtaatctcagctactccagaggctgaggcatgagaatcccttgaaccacagatgcagaggttgcagtgaactgagatcatgccactgcactccatcctgggcaacagagtgagactcggtctcaagagggaaaataaggcatttttctcatttaaataataaatagtattccattatgtatatcaa

SEQ ID NO: 202511 - DNA, 586 bp, Homo sapiens
  Payload ID: 19936
  Gene Name: zinc finger protein 431
  ENST ID: ENST00000599296
  CDS Start-End: 150-518
cctttgtctctcgccgcagcctgagctccaggtctccccttcgctgctctgtgtcctctgctcctagaggcccaacatctgtggccctgtgacctgcaggtattgggagacccacagctaagacaccgggaccccctgaaagcctagaaatggacgacttgaaatatggagtgtatcctctcaaggaagcaagtggatgccctggggctgagaggaatcttctagtttactcttattttgaaaaggagacattgacatttagggatgtggccatagaattctctctggaggagtgggaatgcctgaaccctgctcagcagaatttatatatgaatgtgatgttagaaaactacaaaaacctggtcttcttgggtgttgctgtctctaagcaagacccagtcacctgtctggagcaagaaaaagagccctggaatatgaagagacatgagatggtggatgaacccccaggaaaaactgatcatgatctgcggctcagagagctggaactgagtcaataaactgcttcagggaccacagtaaaaaccaagctatgtgttcttattttaccaaagacctttggccagag

SEQ ID NO: 202512 - DNA, 1971 bp, Homo sapiens
  Payload ID: 19936
  Gene Name: zinc finger protein 431
  ENST ID: ENST00000600692
  CDS Start-End: 161-595
atgtggcggggcctttgtctctcgccgcagcctgagctccaggtctccccttcgctgctctgtgtcctctgctcctagaggcccaacatctgtggccctgtgacctgcaggtattgggagacccacagctaagacaccgggaccccctgaaagcctagaaatggacgacttgaaatatggagtgtatcctctcaaggaagcaagtggatgccctggggctgagaggaatcttctagtttactcttattttgaaaaggagacattgacatttagggatgtggccatagaattctctctggaggagtgggaatgcctgaaccctgctcagcagaatttatatatgaatgtgatgttagaaaactacaaaaacctggtcttcttgggtgttgctgtctctaagcaagacccagtcacctgtctggagcaagaaaaagagccctggaatatgaagagacatgagatggtggatgaacccccaggatacatgtgcaggatgtgcagctatgtgttcttattttaccaaagacctttggccagagcaagacataaaagattcttttcaacaagtaatactgagaagatatggcaaatgtgaacatgagaatttacagttaagaaaaggctccgcaagtgtagatgagtataaggtgcacaaagaaggttataatgagctaaaccagtgtttgacaactacccagagcaaaatatttccatgtgataaatatgtgaaagtctttcataaatttttaaatgcaaatagacataagacaagacatactggaaagaaacctttcaaatgtaaaaaatgtggcaaatcattttgcatgcttttacacctaagtcaacataaaagaattcatattagagagaattcttaccaatgtgaagaatgtggcaaagcttttaaatggttctcaacccttactagacacaagagaattcatactggagagaaacccttcaaatgtgaagaatgtggcaaagcttttaagcagtcctcaacccttactacacataagataattcatactggggagaaaccatatagatgtgaagaatgtggcaaagccttcaaccggtcctcacaccttactacacataagataattcatactggagagaagccctacaaatgtgaagaatgtggcaaagcttttaaccagtcttcaacccttagtacacataagttcattcatgctggagagaaaccctacaaatgtgaggaatgtgacaaagcttttaatcgattctcataccttactaaacataagataattcatactggagaaaaatcttacaaatgtgaagaatgtggcaaaggctttaattggtcctcaacccttactaaacataaaagaattcatactggagagaaaccctacaaatgtgaagtgtgtggcaaagcctttaatgagtcctcaaaccttactacacataagatgattcatactggagagaaaccctacaaatgtgaagaatgtggcaaagcttttaaccggtccccacaacttactgcacataagataattcatactggagagaaaccttacaaatgtgaagaatgtggcaaagcttttagccagtcatcaatccttactacacataagagaattcacactggagagaaaccctacaaatgtgaagaatgtggcaaagcttttaaccgatcctcaaatcttactaaacataagataattcatacaggagagaaatcttacaaatgtgaagaatgtggtaaagcctttaaccaatcctcaactcttactaaacataggaaaattcatactagacagaaaccctacaactgtgaagaatgtgacaatacatttaaccagtcctcaaaccttattaaacaaaataattcatactggagagaaactctacaaatgtcaagaatgtgggaaagcctttaagcagtcctcaactcttactaagcattaaatattggccgggtgcggtggcttatgcaaa

SEQ ID NO: 202513 - DNA, 1082 bp, Homo sapiens
  Payload ID: 19936
  Gene Name: zinc finger protein 431
  ENST ID: ENST00000598331
  CDS Start-End: 108-1082
gctgctctgtgtcctctgctcctagaggcccaacatctgtggccctgtgacctgcaggtattgggagacccacagctaagacaccgggaccccctgaaagcctagaaatggacgacttgaaatatggagtgtatcctctcaaggaagcaagtggatgccctggggctgagaggaatcttctagtttactcttattttgaaaagtctcgctctgtcgcccaggctggaatgcagtggcgctcgctatcttggctcactgtaatatctgcctcccaggttcaagtgattctcgtgcctcagcctcctgagttgctgggactacaggagacattgacatttagggatgtggccatagaattctctctggaggagtgggaatgcctgaaccctgctcagcagaatttatatatgaatgtgatgttagaaaactacaaaaacctggtcttcttgggtgttgctgtctctaagcaagacccagtcacctgtctggagcaagaaaaagagccctggaatatgaagagacatgagatggtggatgaacccccagctatgtgttcttattttaccaaagacctttggccagagcaagacataaaagattcttttcaacaagtaatactgagaagatatggcaaatgtgaacatgagaatttacagttaagaaaaggctccgcaagtgtagatgagtataaggtgcacaaagaaggttataatgagctaaaccagtgtttgacaactacccagagcaaaatatttccatgtgataaatatgtgaaagtctttcataaatttttaaatgcaaatagacataagacaagacatactggaaagaaacctttcaaatgtaaaaaatgtggcaaatcattttgcatgcttttacacctaagtcaacataaaagaattcatattagagagaattcttaccaatgtgaagaatgtggcaaagcttttaaatggttctcaacccttactagacacaagagaattcatactggagagaaacccttcaaatgtgaagaatgtggcaaagcttttaagcagtcctcaacccttactacacataagataattcatactggggag

SEQ ID NO: 202514 - DNA, 2577 bp, Homo sapiens
  Payload ID: 19937
  Gene Name: zinc finger protein 432
  Uniprot ID: O94892
  ENST ID: ENST00000221315
  CDS Start-End: 319-2277
aaacgcggctgaccgtctctggaggtttagagggggagggagttgggcgaggggcccagaagtggaagaagtttagggaagtaagttcagcttttaagaggtcgcggcgattccaaggagagtcagtccacaggtcctggctaccctgggaagagacaagaagtaaatgaagaaagaggaagattccaggacctagatatgatttctgtggacacccttcactggtgactgaagtttctaaatagaaatttaaggcagatccagaggagacaaagacagagtatcccaggtgctggccatttcccacaacagaagaaaatgatcaatgcccaggaattgctgacactggaggatgttactgtggagttcacctgggaggagtggcagctcctgggcccttttcagaaggatttgtaccgggatgtgatgttggagatctacagcaacctgctatcaatgggttatcaagtcagcaaaccagatgcactctccaagttggaacgaggagaagaaccatggacaatggaagatgaaaggcacagtcgaatctgtccagaaaacaacgaagttgatgatcatctgcaggatcacttggaaaatcaaaggatgctgaagagtgtggaacaataccatgaacataatgcatttggaaatactgcctctcaaaccaaaagcctttgtcttttcagggaaaatcatgatacatttgagttatatataaaaactttgaaatcaaatttaagtttagtcaaccagaacaaaagctgtgaaattaacaactctactaaatttagtggagatgggaaatcatttcttcatggtaactatgaagaactttattctgcagctaaattctctgtaagtacaaaagccaatagcactaaatcccaagtcagtaagcatcagagaactcatgaaatagaaaaaaaccacgtatgcagtgaatgtgggaaagcgtttgtcaagaagtctcagctcactgatcatgagagagttcatacaggagaaaaaccttatggatgtactttgtgtgcaaaagtgttctccagaaagtccaggctaaatgaacatcaaagaattcataaaagagagaaatcttttatatgcagtgaatgtggaaaagtcttcactatgaagagccgtctgattgaacatcagcgaactcatactggagagaaaccctacatatgcaatgaatgtggaaaaggcttcccaggcaagcgtaatctcattgtacatcagcgaaatcatactggagagaaatcctatatatgtagtgaatgtggaaaaggcttcactgggaagagcatgcttattatacatcagcgaactcatacaggagagaagccctacatctgtagtgaatgtgggaaaggcttcaccacaaaacactatgtcatcatacatcaacgaaatcatacaggagagaaaccatatatatgcaatgaatgtgggaaaggcttcaccatgaagagccgtatgatcgaacatcaacgaactcatacaggagagaaaccctacatatgcagtgaatgtggaaaaggctttcccaggaagagtaatcttattgtacatcagagaaatcatacagtagagaagtcatatctatgtagtgaatgtggaaaaggttttactgtgaaaagcatgctcatcatacatcagcgaactcatacaggagagaagccctacacatgcagtgaatgtgggaaaggcttccccttgaagagtcggctgattgtacatcagcgaactcatactggagagaaaccttacaggtgcagtgaatgtgggaaaggtttcattgtgaatagcggactgatgttacatcagcgaactcatactggagagaaaccgtacatatgcaatgaatgtggaaaaggttttgcctttaagagcaatcttgttgtacaccagcgaactcatactggagagaaaccctttatgtgcagtgaatgtggaaaaggcttcaccatgaaacgctatctcattgtacatcagcaaattcatacagaagagaaatcttgtatatgtagtgaatgtggaagaggctttgccaaggaaacagagcttgctttacataagcaagttcatactggagaaaaaccttatggatgtaatgaatgtggtaaaggcttcactatgaagagccgtctaattgttcatcaacgaactcatacaggagagaaaccctttgtatgcagtgaatgtagaaaagccttctcctcaaagagaaatctcattgtacatcagcgaactcataatggaaacaaaccctgacaatgcagtggacatgttcatgcctttgggaagaaaatctgccttgtacaacatcagagatttcacagtatagattttctacatgtgtactgagtatgaaaaatcatatttcaaaatccagtgttattcactaggatgaatgctatcaatgtcagaaaggcttcaacatgaattcaggctctgaattctttgatgtaccaatgtatagaaaattactcatctgagagagagtctgtggattgggggtaacctttcatttgtcaaccttcattaaaactatgacaacgtccacatgacaaa

SEQ ID NO: 202515 - DNA, 624 bp, Homo sapiens
  Payload ID: 19937
  Gene Name: zinc finger protein 432
  ENST ID: ENST00000597273
  CDS Start-End: 263-508
cagaagtggaagaagtttagggaagtaagttcagcttttaagaggtcgcggcgattccaaggagagtcagtccacaggtcctggctaccctgggaagagacaagaagtaaatgaagaaagaggaagattccaggacctagatatgatttctgtggacacccttcactggtgactgaagtttctaaatagaaatttaaggcagatccagaggagacaaagacagagtatcccaggtgctggccatttcccacaacagaagaaaatgatcaatgcccaggaattgctgacactggaggatgttactgtggagttcacctgggaggagtggcagctcctgggcccttttcagaaggatttgtaccgggatgtgatgttggagatctacagcaacctgctatcaatgggttatcaagtcagcaaaccagatgcactctccaagttggaacgaggagaagaaccatggacaatggaagatgaaaggcacagtcgaatctgtccaggtatgtgagaagcagcaagatgcgtaagtaatattatagtcagtgaaagaaggctctgtgggtgtctgaggacacagaagcagtgcctacattaggaatgggaatcgttttccctccacaagaa

SEQ ID NO: 202516 - DNA, 4513 bp, Homo sapiens
  Payload ID: 19937
  Gene Name: zinc finger protein 432
  Uniprot ID: O94892
  ENST ID: ENST00000594154
  CDS Start-End: 214-2172
gggagctggtaggagtccctgtccacaggtcctggctaccctgggaagagacaagaagtaaatgaagaaagaggaagattccaggacctagatatgatttctgtggacacccttcactggtgactgaagtttctaaatagaaatttaaggcagatccagaggagacaaagacagagtatcccaggtgctggccatttcccacaacagaagaaaatgatcaatgcccaggaattgctgacactggaggatgttactgtggagttcacctgggaggagtggcagctcctgggcccttttcagaaggatttgtaccgggatgtgatgttggagatctacagcaacctgctatcaatgggttatcaagtcagcaaaccagatgcactctccaagttggaacgaggagaagaaccatggacaatggaagatgaaaggcacagtcgaatctgtccagaaaacaacgaagttgatgatcatctgcaggatcacttggaaaatcaaaggatgctgaagagtgtggaacaataccatgaacataatgcatttggaaatactgcctctcaaaccaaaagcctttgtcttttcagggaaaatcatgatacatttgagttatatataaaaactttgaaatcaaatttaagtttagtcaaccagaacaaaagctgtgaaattaacaactctactaaatttagtggagatgggaaatcatttcttcatggtaactatgaagaactttattctgcagctaaattctctgtaagtacaaaagccaatagcactaaatcccaagtcagtaagcatcagagaactcatgaaatagaaaaaaaccacgtatgcagtgaatgtgggaaagcgtttgtcaagaagtctcagctcactgatcatgagagagttcatacaggagaaaaaccttatggatgtactttgtgtgcaaaagtgttctccagaaagtccaggctaaatgaacatcaaagaattcataaaagagagaaatcttttatatgcagtgaatgtggaaaagtcttcactatgaagagccgtctgattgaacatcagcgaactcatactggagagaaaccctacatatgcaatgaatgtggaaaaggcttcccaggcaagcgtaatctcattgtacatcagcgaaatcatactggagagaaatcctatatatgtagtgaatgtggaaaaggcttcactgggaagagcatgcttattatacatcagcgaactcatacaggagagaagccctacatctgtagtgaatgtgggaaaggcttcaccacaaaacactatgtcatcatacatcaacgaaatcatacaggagagaaaccatatatatgcaatgaatgtgggaaaggcttcaccatgaagagccgtatgatcgaacatcaacgaactcatacaggagagaaaccctacatatgcagtgaatgtggaaaaggctttcccaggaagagtaatcttattgtacatcagagaaatcatacagtagagaagtcatatctatgtagtgaatgtggaaaaggttttactgtgaaaagcatgctcatcatacatcagcgaactcatacaggagagaagccctacacatgcagtgaatgtgggaaaggcttccccttgaagagtcggctgattgtacatcagcgaactcatactggagagaaaccttacaggtgcagtgaatgtgggaaaggtttcattgtgaatagcggactgatgttacatcagcgaactcatactggagagaaaccgtacatatgcaatgaatgtggaaaaggttttgcctttaagagcaatcttgttgtacaccagcgaactcatactggagagaaaccctttatgtgcagtgaatgtggaaaaggcttcaccatgaaacgctatctcattgtacatcagcaaattcatacagaagagaaatcttgtatatgtagtgaatgtggaagaggctttgccaaggaaacagagcttgctttacataagcaagttcatactggagaaaaaccttatggatgtaatgaatgtggtaaaggcttcactatgaagagccgtctaattgttcatcaacgaactcatacaggagagaaaccctttgtatgcagtgaatgtagaaaagccttctcctcaaagagaaatctcattgtacatcagcgaactcataatggaaacaaaccctgacaatgcagtggacatgttcatgcctttgggaagaaaatctgccttgtacaacatcagagatttcacagtatagattttctacatgtgtactgagtatgaaaaatcatatttcaaaatccagtgttattcactaggatgaatgctatcaatgtcagaaaggcttcaacatgaattcaggctctgaattctttgatgtaccaatgtatagaaaattactcatctgagagagagtctgtggattgggggtaacctttcatttgtcaaccttcattaaaactatgacaacgtccacatgacaaatgtgtaaggtacatagtccttttgcagagaatctgaactgattacatacaaacaaattcatgcagagagaaaaccacgttagtaatgtgaactgattaaacagcagtgtgctcctagcatacatgcatataggcagtgtagagcagcctgttgctagattttcacccttggaagacaatgcaatttccaggagcgaattttaatgaatgcagagaatgcactagtgccttcggtgattaattacctcatattttatgtcacaataaacatgtaggaaataaacttgatacatccaatgcagaaaagtcttgaaaattttctaagtaactatgtcttgaaaagtatttactgagataaatcttacaaaggagtaggctaggaaagccttctatgggaagaaagaccctatctcttcagtgatcataatagatcatcaatgaacttacacatactagcagcattatcatgggaaagcctttgcccagaaataaaaccttaacagttggcagatatatttcatactggagaacaagtttcagatggcagtgaatacacgaggatttcagtgatacatgctgcctcatcatcattacttcatacagaaataaaacttatatgaagagtaactttaaaaaggatcaggaaattcatgaagtaaaaaagtctcatgaaaatgatacataatgccgggcatggtggcttgcacctgtaatcccagcactttgggaggccaaggtgggtggatcacttgaggtcgggagttcgagaccagcctgaccaacatggtgaagcccccctctctactaaaaatacaaaattagccgagcatggtggctcacgcttgtaatcccagctactctggaggctaagctggagaatcacttgaacctgggaggcagaggtttcagtgagccaagattgcgccattgcattccagcctgggcaacaagagcgaaactctgcctcaaaaaaaaaaaaaaaaaaccatatttgaggactgtcacaaatctaaactcatgatacacttgatatctattctgtgacagcataccttgcatcatattatcaatgattccataattgtaaagcgggctgttcttatcactgattaaattttaatcctatatataacacaggtgttttctgtgccaatctggtgttatttattagttcttacatattataggccccaaatttatttttttcaatttactgataaatgtaattcagtatatttggatgtgtttatccaagttactaggtaccattatgtagtttacaaaaatgccttaaatgttatttttctaaaatttgttttgaaataattctagattcacaagagattacaaaatatacaaaagtttcctgagtattctttgcttagcatcatcaatgttatcttacataaccataataataaaaaccacggagttctgctcttgttgcccaggttggagtgtaatagcacgatcttggctcactgcaaccccgcctcccaggttcaagagattttcctgcctcagcctcctaagtagctgggattacaggcacccacgaccacgctcgactaatttttgtatttttagtagagacggggtttcactgtgttggccaggctggccttgaactctcgaccccgggcggtccacccgcctcagcctcccaaagtgctgggattacaggcatgagccaccacgcctggcctcctcttgctacctctttatactcacactgtcctcccaatatgacccatggtagccactgatcccattaccctaattttgttatttcaagaatgctattaaaatggaatcgtaaggtacgcaagctttgagatagggctttgttcactcagcaaattacccttaagatctatccaagttgttaggtgtctaaatagttttaatttttgttactgagttagtattcttttaaatggatgcaccagggtttgtgtatccattcactgttgatggacatttgggttgtttccagtgttttgctgttataaataaagatgctgtgactatttgtgtacccg

SEQ ID NO: 202517 - DNA, 764 bp, Homo sapiens
  Payload ID: 19937
  Gene Name: zinc finger protein 432
  ENST ID: ENST00000600368
  CDS Start-End: 228-764
gtcagcgccatgtttcctataaagcctgcaaaatttccacaggtcctggctaccctgggaagagacaagaagtaaatgaagaaagaggaagattccaggacctagatatgatttctgtggacacccttcactggtgactgaagtttctaaatagaaatttaaggcagatccagaggagacaaagacagagtatcccaggtgctggccatttcccacaacagaagaaaatgatcaatgcccaggaattgctgacactggaggatgttactgtggagttcacctgggaggagtggcagctcctgggcccttttcagaaggatttgtaccgggatgtgatgttggagatctacagcaacctgctatcaatgggttatcaagtcagcaaaccagatgcactctccaagttggaacgaggagaagaaccatggacaatggaagatgaaaggcacagtcgaatctgtccagaaaacaacgaagttgatgatcatctgcaggatcacttggaaaatcaaaggatgctgaagagtgtggaacaataccatgaacataatgcatttggaaatactgcctctcaaaccaaaagcctttgtcttttcagggaaaatcatgatacatttgagttatatataaaaactttgaaatcaaatttaagtttagtcaaccagaacaaaagctgtgaaattaacaactctactaaatttagtggagatgggaaatcatttcttcatggtaactatgaagaactttattctgcagctaaattc

SEQ ID NO: 202518 - DNA, 596 bp, Homo sapiens
  Payload ID: 19937
  Gene Name: zinc finger protein 432
  ENST ID: ENST00000598745
  CDS Start-End: 225-596
gtctgcgttgttggtggcgctatatggtggagtccacaggtcctggctaccctgggaagagacaagaagtaaatgaagaaagaggaagattccaggacctagatatgatttctgtggacacccttcactggtgactgaagtttctaaatagaaatttaaggcagatccagaggagacaaagacagagtatcccaggtgctggccatttcccacaacagaagaaaatgatcaatgcccaggaattgctgacactggaggatgttactgtggagttcacctgggaggagtggcagctcctgggcccttttcagaaggatttgtaccgggatgtgatgttggagatctacagcaacctgctatcaatgggttatcaagtcagcaaaccagatgcactctccaagttggaacgaggagaagaaccatggacaatggaagatgaaaggcacagtcgaatctgtccagaaaacaacgaagttgatgatcatctgcaggatcacttggaaaatcaaaggatgctgaagagtgtggaacaataccatgaacataatgcatttggaaatactgcctctcaaaccaaaagcctttgtcttttcagg

SEQ ID NO: 202519 - DNA, 604 bp, Homo sapiens
  Payload ID: 19937
  Gene Name: zinc finger protein 432
  ENST ID: ENST00000601310
  CDS Start-End: 497-604
acttttaaagaggtgtgagagtaacattgtataaaggaaaaaatgtagtttctcaccatccatatggcctgatttaaaaaactgatatgagaattacctactgcttaggcatgatgctatgtggattctcctttgtgacctcccctttcatcttcatgttacttccacacttcaccgaagaaaggcatttggcctacattgagggtcttgtgtttccttggtttgagagaaccaaataaagagacaaatattcagggccacgtgttaaggtgaatgtacccctgaaagttgttttgctcttcagtccacaggtcctggctaccctgggaagagacaagaagtaaatgaagaaagaggaagattccaggacctagatatgatttctgtggacacccttcactggtgactgaagtttctaaatagaaatttaaggcagatccagaggagacaaagacagagtatcccaggtgctggccatttcccacaacagaagaaaatgatcaatgcccaggaattgctgacactggaggatgttactgtggagttcacctgggaggagtggcagctcctgggcccttttcagaaggatttgtaccgggatgtg

SEQ ID NO: 202520 - DNA, 2280 bp, Homo sapiens
  Payload ID: 19938
  Gene Name: zinc finger protein 433
  Uniprot ID: Q8N7K0
  ENST ID: ENST00000344980
  CDS Start-End: 172-2193
gtccatcggggagggcgaaggccctgctctcctcggttcccggctccaggcggcgagctgaggttgggagcctggctttcccctccgagagggttcaggtgcctctgccatagcttctgtcgcctgtgctgtgacccgcactggtcgtgggagtcacctgaaaggcaagaaatgatgtttcaggattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgacccaggttccagatgacatgctgaagaaaacaactactggagtaaaatcatgcgaaagcagtgtgtatggagaagtaggcagtgctcattcatctcttaataggcacatcagagatgacactggacacaaggcatatgagtatcaagaatatggacagaaaccatataaatgtaaatactgtaaaaaacctttcaactgtctctcctctgttcagacacatgaaagggctcatagtggaaggaaactctatgtttgtgaggaatgcggaaaaacatttatttcccattcaaaccttcaaagacacaggataatgcaccgtggagatggaccttataagtgtaaattttgtgggaaagccttgatgtttctcagtttgtatcttatccacaaacgaactcacactggagagaaaccatatcaatgtaaacagtgtggtaaagcctttagtcattctagtagccttcgaatacatgaaagaactcacactggggagaagccttataaatgtaatgaatgtgggaaagcattccatagttccacatgccttcatgctcataaaagaactcacactggggagaagccatatgaatgtaaacagtgtgggaaagccttcagctcttcccattcctttcaaatacatgaaagaactcacacgggggagaagccatatgaatgtaaggaatgtggaaaagcattcaagtgtcccagttctgttcgcagacatgaaagaacccactctaggaaaaaaccctatgaatgtaaacattgtgggaaagtattatcttatcttaccagctttcaaaaccacttgggaatgcacactggagagatatctcataaatgtaagatatgtgggaaagccttttattctcccagttcacttcaaacacatgaaaaaactcacactggagagaaaccctataaatgcaaccaatgtggtaaagcctttaattcttccagttccttccgatatcatgaaagaactcacactggagagaaaccttacgagtgtaagcaatgtgggaaagccttcagatctgcctcactccttcaaacacatggtaggactcacacgggagagaaaccctatgcatgtaaggaatgtggaaaaccatttagtaatttctctttctttcaaatacatgaaaggatgcacagagaagagaagccgtatgaatgtaagggttatgggaaaacattcagtttgcccagtttatttcatagacatgaaaggactcacactggaggaaaaacctatgaatgcaagcagtgtggcagatccttcaactgttcgagctcctttcgatatcatggaaggactcacactggagagaaaccctatgaatgcaagcaatgtggaaaagccttcagatctgcctcacagcttcaaattcatggaaggactcacactggagagaaaccttatgaatgtaagcagtgtgggaaagcctttggatctgcctcacaccttcaaatgcatggaaggactcacactggagagaaaccctatgaatgtaagcagtgtgggaagtcttttggatgtgcctcgcgacttcaaatgcatggaaggactcacactggagagaaaccgtataaatgtaagcaatgtgggaaagcttttggatgtccctcaaaccttcgaaggcatggaaggactcacactggagagaaaccctataaatgtaaccaatgtggtaaagtctttagatgttcttcacaacttcaagtgcatggaagggctcactgcatagacaccccataaccccaggctttaggaggctgaggtggggggactgcttaagcccaggagttcaagaccagcctgggcaacatagtgagactctgttat

SEQ ID NO: 202521 - DNA, 2322 bp, Homo sapiens
  Payload ID: 19938
  Gene Name: zinc finger protein 433
  Uniprot ID: Q8N7K0
  ENST ID: ENST00000419886
  CDS Start-End: 293-2209
cctgctctcctcggttcccggctccaggcggcgagctgaggttgggagcctggctttcccctccgagagggttcaggtgcctctgccatagcttctgtcgcctgtgctgtgacccgcactggtcgtgggagtcacctgaaaggcaagaaatgggagacaggaattgcagggagaatcatgcatcaatgcctggaaaggtgattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgacccaggttccagatgacatgctgaagaaaacaactactggagtaaaatcatgcgaaagcagtgtgtatggagaagtaggcagtgctcattcatctcttaataggcacatcagagatgacactggacacaaggcatatgagtatcaagaatatggacagaaaccatataaatgtaaatactgtaaaaaacctttcaactgtctctcctctgttcagacacatgaaagggctcatagtggaaggaaactctatgtttgtgaggaatgcggaaaaacatttatttcccattcaaaccttcaaagacacaggataatgcaccgtggagatggaccttataagtgtaaattttgtgggaaagccttgatgtttctcagtttgtatcttatccacaaacgaactcacactggagagaaaccatatcaatgtaaacagtgtggtaaagcctttagtcattctagtagccttcgaatacatgaaagaactcacactggggagaagccttataaatgtaatgaatgtgggaaagcattccatagttccacatgccttcatgctcataaaagaactcacactggggagaagccatatgaatgtaaacagtgtgggaaagccttcagctcttcccattcctttcaaatacatgaaagaactcacacgggggagaagccatatgaatgtaaggaatgtggaaaagcattcaagtgtcccagttctgttcgcagacatgaaagaacccactctaggaaaaaaccctatgaatgtaaacattgtgggaaagtattatcttatcttaccagctttcaaaaccacttgggaatgcacactggagagatatctcataaatgtaagatatgtgggaaagccttttattctcccagttcacttcaaacacatgaaaaaactcacactggagagaaaccctataaatgcaaccaatgtggtaaagcctttaattcttccagttccttccgatatcatgaaagaactcacactggagagaaaccttacgagtgtaagcaatgtgggaaagccttcagatctgcctcactccttcaaacacatggtaggactcacacgggagagaaaccctatgcatgtaaggaatgtggaaaaccatttagtaatttctctttctttcaaatacatgaaaggatgcacagagaagagaagccgtatgaatgtaagggttatgggaaaacattcagtttgcccagtttatttcatagacatgaaaggactcacactggaggaaaaacctatgaatgcaagcagtgtggcagatccttcaactgttcgagctcctttcgatatcatggaaggactcacactggagagaaaccctatgaatgcaagcaatgtggaaaagccttcagatctgcctcacagcttcaaattcatggaaggactcacactggagagaaaccttatgaatgtaagcagtgtgggaaagcctttggatctgcctcacaccttcaaatgcatggaaggactcacactggagagaaaccctatgaatgtaagcagtgtgggaagtcttttggatgtgcctcgcgacttcaaatgcatggaaggactcacactggagagaaaccgtataaatgtaagcaatgtgggaaagcttttggatgtccctcaaaccttcgaaggcatggaaggactcacactggagagaaaccctataaatgtaaccaatgtggtaaagtctttagatgttcttcacaacttcaagtgcatggaagggctcactgcatagacaccccataaccccaggctttaggaggctgaggtggggggactgcttaagcccaggagttcaagaccagcctgggcaacatagtgagactctgttataaaaattaaataaataaataaaaaga

SEQ ID NO: 202522 - DNA, 567 bp, Homo sapiens
  Payload ID: 19938
  Gene Name: zinc finger protein 433
  ENST ID: ENST00000411841
  CDS Start-End: 337-567
aatcaggggcgctgggcggggcctgccgagtgtccatcggggagggcgaaggccctgctctcctcggttcccggctccaggcggcgagctgaggttgggagcctggctttcccctccgagagggttcaggtgcctctgccatagcttctgtcgcctgtgctgtgacccgcactggtcgtgggagtcacctgaaaggcaagaaatggaacacctttaagtggttttctaccctgggtgggccaggtgttccctgccttcattccggtaaaccaacagtcttcattgtgggtgtcatggccatcacgaacatgtcacagtgctgcagagattttgtttatggccagttttggagccagtttatggccagatttgggggcctgttcccaacacctaagtctctatcacagcgtgacggttgaattggcagccagtaccgccaggcatcctgcatcatcactgcaggaggattcagtggcctttgaggatgtggctgtgaccttcacccaagaggagtgggctttgctggatccttcccagaaaaatctctgtagagatgtgatgcaagaa

SEQ ID NO: 202523 - DNA, 721 bp, Homo sapiens
  Payload ID: 19938
  Gene Name: zinc finger protein 433
  ENST ID: ENST00000455504
  CDS Start-End: 224-721
ggctccaggcggcgagctgaggttgggagcctggctttcccctccgagagggttcaggtgcctctgccatagcttctgtcgcctgtgctgtgacccgcactggtcgtgggagtcacctgaaaggcaagaaatgggagacaggaattgcagggagaatcatgcatcaatgcctggaaaggtcatcatggaaacctcttgggaatagagtataggcttcccagtgatgttagtcttatccatcctcctctatacatgtgagatgtttcaggattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgacccaggttccagatgacatgctgaagaaaacaactactggagtaaaatcatgcgaaagcagtgtgtatggagaagtaggcagtgctcattcatctcttaataggcacatcagagatgacactggacacaaggcatatgagtatcaagaatatggacagaaaccatataaatgtaaatactgtaaaaaacctttcaactgtctctcc

SEQ ID NO: 202524 - DNA, 709 bp, Homo sapiens
  Payload ID: 19938
  Gene Name: zinc finger protein 433
  ENST ID: ENST00000548669
  CDS Start-End: 158-283
gcgaaggccctgctctcctcggttcccggctccaggcggcgagctgaggttgggagcctggctttcccctccgagagggttcaggtgcctctgccatagcttctgtcgcctgtgctgtgacccgcactggtcgtgggagtcacctgaaaggcaagaaatgggagacaggaattgcagggagaatcatgcatcaatgcctggaaaggtttctggaagcctggaagttatgaagtccatgttcaaggtgctgacagatctggtgcctggattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgacccaggttccagatgacatgctgaagaaaacaactactggagtaaaatcatgcgaaagcagtgtgtatggagaagtaggcagtgctcattcatctcttaataggcacatcagagatgacactggacacaaggcatatgagtatcaagaatatggacagaaaccatataaatgtaaatactgtaaaaaacctttcaa

SEQ ID NO: 202525 - DNA, 467 bp, Homo sapiens
  Payload ID: 19938
  Gene Name: zinc finger protein 433
  ENST ID: ENST00000550745
  CDS Start-End: 236-467
gtgtccatcggggagggcgaaggccctgctctcctcggttcccggctccaggcggcgagctgaggttgggagcctggctttcccctccgagagggttcaggtgcctctgccatagcttctgtcgcctgtgctgtgacccgcactggtcgtgggagtcacctgaaaggcaagaaatgttctggaagcctggaagttatgaagtccatgttcaaggtgctgacagatctggtgcctgatgtttcaggattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaag

SEQ ID NO: 202526 - DNA, 692 bp, Homo sapiens
  Payload ID: 19938
  Gene Name: zinc finger protein 433
  ENST ID: ENST00000478765
  CDS Start-End: 341-692
taggcatttttttttcaaggatatgcagcctcaggactgctaatgttaactttttctgcacaggaatttggaagactttgttatggcaggtgccgtactcccactttacaaacaaacattaggggcagcccaggcagcacacctttctggatttaccaaaaatacacattttcctattctactgttgctttaccacatggttcagttgtagcctcagaattactttatggaagaaactgagtgtagacagagagtatgaggtctgatggtcatggaataattgttttgagtccacagcatcatggaaacctcttgggaatagagtataggcttcccagtgatgttagtcttatccatcctcctctatacatgtgagatgtttcaggattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgacccaggttccagatgacatgctgaagaaaacaactactggagtaaaatcatgcgaaagca

SEQ ID NO: 202527 - DNA, 785 bp, Homo sapiens
  Payload ID: 19938
  Gene Name: zinc finger protein 433
  ENST ID: ENST00000550507
  CDS Start-End: 165-785
ggggagggcgaaggccctgctctcctcggttcccggctccaggcggcgagctgaggttgggagcctggctttcccctccgagagggttcaggtgcctctgccatagcttctgtcgcctgtgctgtgacccgcactggtcgtgggagtcacctgaaaggcaagaaatggattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgacccaggttccagatgacatgctgaagaaaacaactactggagtaaaatcatgcgaaagcagtgtgtatggagaagtaggcagtgctcattcatctcttaataggcacatcagagatgacactggacacaaggcatatgagtatcaagaatatggacagaaaccatataaatgtaaatactgtaaaaaacctttcaactgtctctcctctgttcagacacatgaaagggctcatagtggaaggaaactctatgtttgtgaggaatgcggaaaaacatttatttcccattcaaaccttcaaagacacaggataatgcaccgtggagatggaccttataagtgtaaattttgtgggaaagccttgatgtttctc

SEQ ID NO: 202528 - DNA, 583 bp, Homo sapiens
  Payload ID: 19938
  Gene Name: zinc finger protein 433
  ENST ID: ENST00000552904
  CDS Start-End: 226-583
tcggttcccggctccaggcggcgagctgaggttgggagcctggctttcccctccgagagggttcaggtgcctctgccatagcttctgtcgcctgtgctgtgacccgcactggtcgtgggagtcacctgaaaggattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgacccaggttccagatgacatgctgaagaaaacaactactggagtaaaatcatgcgaaagcagtgtgtatggagaagtaggcagtgctcattcatctcttaataggcacatcagagatgacactggacacaaggcatatgagtatcaagaatatggacagaaaccatataaatgtaaatactgtaaaaaacctttcaactgtctct

SEQ ID NO: 202529 - DNA, 449 bp, Homo sapiens
  Payload ID: 19938
  Gene Name: zinc finger protein 433
  ENST ID: ENST00000547560
  CDS Start-End: 293-449
ggttcccggctccaggcggcgagctgaggttgggagcctggctttcccctccgagagggttcaggtgcctctgccatagcttctgtcgcctgtgctgtgacccgcactggtcgtgggagtcacctgaaaggcaagaaatgttctggaagcctggaagttatgaagtccatgttcaaggtgctgacagatctggtgcctggattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgaccc

SEQ ID NO: 202530 - DNA, 4071 bp, Homo sapiens
  Payload ID: 19939
  Gene Name: zinc finger protein 436
  Uniprot ID: Q9C0F3
  ENST ID: ENST00000314011
  CDS Start-End: 138-1550
gctgcggctctggaacccgttcgcggtctctcaggttttggagacgacgatctagtggatcttttgcgggacaggagcgctgtctgctagctgcttttcctgctctctctccctggaggcgaacccttgtgctcgagatggcagccaccctgctcatggctgggtcccaggcacctgtgacgtttgaagatatggccatgtatctcacccgggaagaatggagacctctggacgctgcacagagggacctttaccgggatgttatgcaggagaattatggaaatgttgtctcactagattttgagatcaggagtgagaacgaggtaaatcccaagcaagagattagtgaagatgtacaatttgggactacatctgaaagacctgctgagaatgctgaggaaaatcctgaaagtgaagagggctttgaaagcggagataggtcagaaagacaatggggagatttaacagcagaagagtgggtaagctatcctctccaaccagtcactgatctacttgtccacaaagaagtccacacaggcatccgctatcatatatgttctcattgtggaaaggccttcagtcagatctcagaccttaatcgacatcagaagacccacactggagacagaccctataaatgttatgaatgtggaaaaggcttcagtcgcagctcacaccttattcagcatcaaagaacacatactggggagaggccttatgactgtaacgagtgtgggaaaagttttggaagaagttctcacctgattcagcatcagacaatccacactggagagaagcctcacaaatgtaatgagtgtggaaaaagtttctgccgtctctctcacctaatccaacaccaaaggacccacagtggtgagaaaccctatgagtgtgaggagtgtgggaaaagcttcagccggagctctcacctagctcagcaccagaggacccacacgggtgagaaaccttatgaatgtaacgaatgtggccgaggcttcagtgagagatctgatctcatcaaacactatcgagtccacacaggggagaggccctacaagtgtgatgagtgtgggaagaatttcagtcagaactccgaccttgtgcgtcatcgcagagcccacacgggagagaagccataccactgtaacgaatgtggggaaaatttcagccgcatctcacacttggttcagcaccagagaactcacactggagagaagccatatgaatgcaatgcttgtgggaaaagcttcagccggagctctcatctcatcacacaccagaaaattcacactggagagaagccttatgagtgtaatgagtgttggcgaagctttggtgaaaggtcagatctaattaaacatcagagaacccacacaggggagaagccctacgagtgtgtgcagtgtgggaaaggtttcacccagagctccaacctcatcacacatcaaagagttcacacgggagagaaaccttatgaatgtaccgaatgtgagaagagtttcagcaggagctcagctcttattaaacataagagagttcatacggactaagctgtaattatgatggctgagaaatgattcatttgaagatacaattttatttgatatcaatgaacgccctcaagactgagctgcttttatcatactctcctagttgtgggccacgatttaaaccatcagagatgacaagccatttgaaattctgaccctcagctttgggaatgttatctcctccaaaatggtgatttttattcactcaatgggttacttcattaaaagcagccccacaagtaactggaaatctgaagaccaggggacaaatgctggtgaatgcttaggcctggaaatggagtaaatctttcaatgttattttctcccatccttggcccaaggaactatgctaagtgaaacgtgggactgtaatagggtggtaatggctgctttggaaaaaggcaactagagactctgcctaaattgccacacctattcacacaccatagtagttgggcacacacatcttcccttccaaagggctttttccttgagttgctcatgcatttgtatcttttccatcttcctgagggcaagattttgcacgatgaaggcaatgattgtaacttttctccttctcattgtttctaattagctcctttaaagcttgcatctttgtgaaggctaactgaagatacggttggaaaggaaaaatgagacacaggtttggggaccaaggacccatcaatgatggtgactttagcagaagatgcccacagttattactgccattaatcagatttatgaattttctttggggatcactatagggaatattgtatagaaaatatcttcaagaaaagataggaccatcagtgacagttaagtgtaaggagcaagtggaattgagtccttcagggaaggaaccacagagtcccttcccaaggaatgtaggtcgtttctgtgttctttcccttctaatctttaagatcaactcttcctatcctgctaactctaagatttgataagggccacatcccagtgtttatcttagcttgcatcagggcatgtgtatgtacagtaatgtgtattcctgtggtttttctaatagaaactgaatttacagagacttagcatgttcttgggtgatgtgagtcatgtgacagaagtacagacataactccaatgtgagaaatgtccttttttcattatggaaaataatttaaacactagtgctttagtgtgcactctcctgtaaggtctgtctttgtacagagctaagcacttgtttgtatgtgtttgtcaattgtggaagataatgaccagacaaataggtcgattgtcctattctcagaatgaattatcttctatggtaatgaagaactctttggcttagtcagaaggaattaacgaacctcggtaggaatgtatttccatcctcccaccctacagatataagaggttaaaataacagttcgcccaatttaagcccagtagtgtcagttttcctaatctcagtccaggtaggaattaagaaatatctcaagtgttgatgctatccaagcatgttggggtggaagggaattggtgcccagaaaatgggactggagtgaggaatatcttttcttttgagagtacccccagtttatttctactgtgctttattgctactgttctttattgtgaatgttgtaacattttaaaaatgttttgccatagctttttaggacttggtgttaaaggagccagtggtctctctgggtgggtactataatgagttattgtgacccacagctgtgtgggaccacatcacttgttaataacacaacctttaaagtaacccatcttccaggggggttccttcatgttgccactcctttttaaggacaaactcaggcaaggagcatgtttttttgttatttacaaaatctagcagactgtgggtatccatattttaattgtcgggtgacacatgttcttggtaactaaactcaaatatgtcttttctcatatatgttgctgatggttttaataaatgtcaaagttctcctgttgcttctgtgagccactatgggtatcagcttgggagtggccatagatgaccgcatttccatgacctaactgtatttcacccccttttccttccctactgttcttgccccaccccaaccagttcctgctgctgcttttggcttcttggaggtgaagggcttaaaacaaggcttctaagcacccagctatctccatacatgaacaatctagctgggaaacttaagggacaagggccacaccagctgtctcctctttctgccaattgttgcccgtttgctgtgttgaactttgtatagaactcatgcatcagactcccttcactaatgctttttgcatgccttctgctcccaagtccctggctgcctctgcacatcccgtgaacactttgtgcctgttttctatggttgtggagaattaatgaacaaatcaatatgtagaacagttttccttatggtattggtcacagttatcctagtgtttgtattattctaacaatattctataattaaaaatataatttttaaagtca

SEQ ID NO: 202531 - DNA, 3788 bp, Homo sapiens
  Payload ID: 19939
  Gene Name: zinc finger protein 436
  Uniprot ID: Q9C0F3
  ENST ID: ENST00000374608
  CDS Start-End: 382-1794
gccggaaaggacccggcctcgagatggcagagcggaggcgttccctgggctgagctgagcacctcctccctgagacagcagcggtctaacccccggcgcgggagggacccagccagggggctgtcctagtagattccggcattgcctccaccccgctgtggcggagacgcagagggcgggtcgcgctcgagggtcagggaggagagtgacccggccctggtccagggccctccctgcccgccttggggccagaactccagccctggggagtgggcagggcctgttttccgtgcctcacgccctgcttttcgcctccttcagcgctgtctgctagctgcttttcctgctctctctccctggaggcgaacccttgtgctcgagatggcagccaccctgctcatggctgggtcccaggcacctgtgacgtttgaagatatggccatgtatctcacccgggaagaatggagacctctggacgctgcacagagggacctttaccgggatgttatgcaggagaattatggaaatgttgtctcactagattttgagatcaggagtgagaacgaggtaaatcccaagcaagagattagtgaagatgtacaatttgggactacatctgaaagacctgctgagaatgctgaggaaaatcctgaaagtgaagagggctttgaaagcggagataggtcagaaagacaatggggagatttaacagcagaagagtgggtaagctatcctctccaaccagtcactgatctacttgtccacaaagaagtccacacaggcatccgctatcatatatgttctcattgtggaaaggccttcagtcagatctcagaccttaatcgacatcagaagacccacactggagacagaccctataaatgttatgaatgtggaaaaggcttcagtcgcagctcacaccttattcagcatcaaagaacacatactggggagaggccttatgactgtaacgagtgtgggaaaagttttggaagaagttctcacctgattcagcatcagacaatccacactggagagaagcctcacaaatgtaatgagtgtggaaaaagtttctgccgtctctctcacctaatccaacaccaaaggacccacagtggtgagaaaccctatgagtgtgaggagtgtgggaaaagcttcagccggagctctcacctagctcagcaccagaggacccacacgggtgagaaaccttatgaatgtaacgaatgtggccgaggcttcagtgagagatctgatctcatcaaacactatcgagtccacacaggggagaggccctacaagtgtgatgagtgtgggaagaatttcagtcagaactccgaccttgtgcgtcatcgcagagcccacacgggagagaagccataccactgtaacgaatgtggggaaaatttcagccgcatctcacacttggttcagcaccagagaactcacactggagagaagccatatgaatgcaatgcttgtgggaaaagcttcagccggagctctcatctcatcacacaccagaaaattcacactggagagaagccttatgagtgtaatgagtgttggcgaagctttggtgaaaggtcagatctaattaaacatcagagaacccacacaggggagaagccctacgagtgtgtgcagtgtgggaaaggtttcacccagagctccaacctcatcacacatcaaagagttcacacgggagagaaaccttatgaatgtaccgaatgtgagaagagtttcagcaggagctcagctcttattaaacataagagagttcatacggactaagctgtaattatgatggctgagaaatgattcatttgaagatacaattttatttgatatcaatgaacgccctcaagactgagctgcttttatcatactctcctagttgtgggccacgatttaaaccatcagagatgacaagccatttgaaattctgaccctcagctttgggaatgttatctcctccaaaatggtgatttttattcactcaatgggttacttcattaaaagcagccccacaagtaactggaaatctgaagaccaggggacaaatgctggtgaatgcttaggcctggaaatggagtaaatctttcaatgttattttctcccatccttggcccaaggaactatgctaagtgaaacgtgggactgtaatagggtggtaatggctgctttggaaaaaggcaactagagactctgcctaaattgccacacctattcacacaccatagtagttgggcacacacatcttcccttccaaagggctttttccttgagttgctcatgcatttgtatcttttccatcttcctgagggcaagattttgcacgatgaaggcaatgattgtaacttttctccttctcattgtttctaattagctcctttaaagcttgcatctttgtgaaggctaactgaagatacggttggaaaggaaaaatgagacacaggtttggggaccaaggacccatcaatgatggtgactttagcagaagatgcccacagttattactgccattaatcagatttatgaattttctttggggatcactatagggaatattgtatagaaaatatcttcaagaaaagataggaccatcagtgacagttaagtgtaaggagcaagtggaattgagtccttcagggaaggaaccacagagtcccttcccaaggaatgtaggtcgtttctgtgttctttcccttctaatctttaagatcaactcttcctatcctgctaactctaagatttgataagggccacatcccagtgtttatcttagcttgcatcagggcatgtgtatgtacagtaatgtgtattcctgtggtttttctaatagaaactgaatttacagagacttagcatgttcttgggtgatgtgagtcatgtgacagaagtacagacataactccaatgtgagaaatgtccttttttcattatggaaaataatttaaacactagtgctttagtgtgcactctcctgtaaggtctgtctttgtacagagctaagcacttgtttgtatgtgtttgtcaattgtggaagataatgaccagacaaataggtcgattgtcctattctcagaatgaattatcttctatggtaatgaagaactctttggcttagtcagaaggaattaacgaacctcggtaggaatgtatttccatcctcccaccctacagatataagaggttaaaataacagttcgcccaatttaagcccagtagtgtcagttttcctaatctcagtccaggtaggaattaagaaatatctcaagtgttgatgctatccaagcatgttggggtggaagggaattggtgcccagaaaatgggactggagtgaggaatatcttttcttttgagagtacccccagtttatttctactgtgctttattgctactgttctttattgtgaatgttgtaacattttaaaaatgttttgccatagctttttaggacttggtgttaaaggagccagtggtctctctgggtgggtactataatgagttattgtgacccacagctgtgtgggaccacatcacttgttaataacacaacctttaaagtaacccatcttccaggggggttccttcatgttgccactcctttttaaggacaaactcaggcaaggagcatgtttttttgttatttacaaaatctagcagactgtgggtatccatattttaattgtcgggtgacacatgttcttggtaactaaactcaaatatgtcttttctcatatatgttgctgatggttttaataaatgtcaaagttctcctgtt

SEQ ID NO: 202532 - DNA, 3788 bp, Homo sapiens; identical to SEQ ID NO: 202531
  Payload ID: 19939
  Gene Name: Zinc finger protein 436
  ENST ID: ENST00000635349
  CDS Start-End: 382-1794

SEQ ID NO: 202533 - DNA, 4071 bp, Homo sapiens; identical to SEQ ID NO: 202530
  Payload ID: 19939
  Gene Name: Zinc finger protein 436
  ENST ID: ENST00000635400
  CDS Start-End: 138-1550

SEQ ID NO: 202534 - DNA, 3243 bp, Homo sapiens
  Payload ID: 19940
  Gene Name: zinc finger protein 438
  Uniprot ID: Q7Z4V0
  ENST ID: ENST00000331737
  CDS Start-End: 460-2916
aattaattaaaaggatttacggtatatcttatgactctacaggagccttgggatatagataaaaatgaatgccatttcccatccagtactgaagtgttaaagttagaagacatttgctaagtcaaatcacttcaggaagctcatcctgggagtggaggaacagatgttctgtcattgccacattcttctggacacagactggagaactataggaatgtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaagatccaatcctttgatggcaatggaggaggaggaggacacacgttgcacattctccaaatatccaacagcctttctggatttctcagagtcctatggatagtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtgaatctgggaccctccatcaactccaagctgctggggatgtccacccagaactatgccctgatgcaggttgctggccaggaggggacattttctcttgttgctctgccacatgttgcctcagctcagccaattcagaaacccagaatgtccctacctgaaaacctgaaacttcctattcctagatatcaaccccctagaaatagcaaagcatcaagaaagaaacccatcctgatctttcctaagagtggctgtagcaaagctcctgcccaaacccaaatgtgtcctcagatgtccccttccccacctcaccaccctgaactcctgtacaaacccagtccatttgaggaagtaccatcactagagcaagccccagccagcattagcacagctgcgctgaccaatggaagtgaccatggggacttgagaccaccagtgaccaacacccatggcagtctgaaccctcctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttctaactatatgcagtcttattttaaaatacgtactgattcttaatatcttagactttcagaataaataaaaagatcaaaatttgaagattgaaatttagcagaatataggctgttcttcaaatacagctctcagtgaaaa

SEQ ID NO: 202535 - DNA, 3144 bp, Homo sapiens
  Payload ID: 19940
  Gene Name: zinc finger protein 438
  Uniprot ID: Q7Z4V0
  ENST ID: ENST00000361310
  CDS Start-End: 331-2817
aattaattaaaaggatttacggtatatcttatgactctacaggagccttgggatatagataaaaatgaatgccatttcccatccagtactgaagtgttaaagttagaagacatttgctaagtcaaatcacttcaggaagctcatcctgggagtggaggaacagatgttctgtcattgccacattcttctggacacagactggagaactataggaatgtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaaggtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtgaatctgggaccctccatcaactccaagctgctggggatgtccacccagaactatgccctgatgcaggttgctggccaggaggggacattttctcttgttgctctgccacatgttgcctcagctcagccaattcagaaacccagaatgtccctacctgaaaacctgaaacttcctattcctagatatcaaccccctagaaatagcaaagcatcaagaaagaaacccatcctgatctttcctaagagtggctgtagcaaagctcctgcccaaacccaaatgtgtcctcagatgtccccttccccacctcaccaccctgaactcctgtacaaacccagtccatttgaggaagtaccatcactagagcaagccccagccagcattagcacagctgcgctgaccaatggaagtgaccatggggacttgagaccaccagtgaccaacacccatggcagtctgaaccctcctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttctaactatatgcagtcttattttaaaatacgtactgattcttaatatcttagactttcagaataaataaaaagatcaaaatttgaagattgaaatttagcagaatataggctgttcttcaaatacagctctcagtgaaaa

SEQ ID NO: 202536 - DNA, 2173 bp, Homo sapiens
  Payload ID: 19940
  Gene Name: zinc finger protein 438
  ENST ID: ENST00000375311
  CDS Start-End: 815-1993
gggggcccagcggcccgcgccccgtggcttgacctccccgactgctgggcccgtgacgtcaccccgctgtgacgcgcacgctgtaggaaaactataaaaatgaatgccatttcccatccagtactgaagtgttaaagttagaagacatttgctaagtcaaatcacttcaggtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaaggtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagca

SEQ ID NO: 202537 - DNA, 3106 bp, Homo sapiens
  Payload ID: 19940
  Gene Name: zinc finger protein 438
  Uniprot ID: Q7Z4V0
  ENST ID: ENST00000413025
  CDS Start-End: 297-2783
agggcggagcctgggggcccagcggcccgcgccccgtggcttgacctccccgactgctgggcccgtgacgtcaccccgctgtgacgcgcacgctgtaggaaaactataaaaatgaatgccatttcccatccagtactgaagtgttaaagttagaagacatttgctaagtcaaatcacttcaggtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaaggtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtgaatctgggaccctccatcaactccaagctgctggggatgtccacccagaactatgccctgatgcaggttgctggccaggaggggacattttctcttgttgctctgccacatgttgcctcagctcagccaattcagaaacccagaatgtccctacctgaaaacctgaaacttcctattcctagatatcaaccccctagaaatagcaaagcatcaagaaagaaacccatcctgatctttcctaagagtggctgtagcaaagctcctgcccaaacccaaatgtgtcctcagatgtccccttccccacctcaccaccctgaactcctgtacaaacccagtccatttgaggaagtaccatcactagagcaagccccagccagcattagcacagctgcgctgaccaatggaagtgaccatggggacttgagaccaccagtgaccaacacccatggcagtctgaaccctcctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttctaactatatgcagtcttattttaaaatacgtactgattcttaatatcttagactttcagaataaataaaaagatcaaaatttgaagattgaaatttagcagaatataggctgttcttcaaatacagctctcagtg

SEQ ID NO: 202538 - DNA, 3164 bp, Homo sapiens
  Payload ID: 19940
  Gene Name: zinc finger protein 438
  Uniprot ID: Q7Z4V0
  ENST ID: ENST00000436087
  CDS Start-End: 355-2841
agggcggagcctgggggcccagcggcccgcgccccgtggcttgacctccccgactgctgggcccgtgacgtcaccccgctgtgacgcgcacgctgtaggaaaactaattaattaaaaggatttacggtatatcttatgactctacaggagccttgggatatagataaaaatgaatgccatttcccatccagtactgaagtgttaaagttagaagacatttgctaagtcaaatcacttcaggtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaaggtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtgaatctgggaccctccatcaactccaagctgctggggatgtccacccagaactatgccctgatgcaggttgctggccaggaggggacattttctcttgttgctctgccacatgttgcctcagctcagccaattcagaaacccagaatgtccctacctgaaaacctgaaacttcctattcctagatatcaaccccctagaaatagcaaagcatcaagaaagaaacccatcctgatctttcctaagagtggctgtagcaaagctcctgcccaaacccaaatgtgtcctcagatgtccccttccccacctcaccaccctgaactcctgtacaaacccagtccatttgaggaagtaccatcactagagcaagccccagccagcattagcacagctgcgctgaccaatggaagtgaccatggggacttgagaccaccagtgaccaacacccatggcagtctgaaccctcctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttctaactatatgcagtcttattttaaaatacgtactgattcttaatatcttagactttcagaataaataaaaagatcaaaatttgaagattgaaatttagcagaatataggctgttcttcaaatacagctctcagtg

SEQ ID NO: 202539 - DNA, 3245 bp, Homo sapiens
  Payload ID: 19940
  Gene Name: zinc finger protein 438
  Uniprot ID: Q7Z4V0
  ENST ID: ENST00000442986
  CDS Start-End: 436-2922
agggcggagcctgggggcccagcggcccgcgccccgtggcttgacctccccgactgctgggcccgtgacgtcaccccgctgtgacgcgcacgctgtaggaaaactaattaattaaaaggatttacggtatatcttatgactctacaggagccttgggatatagataaaaatgaatgccatttcccatccagtactgaagtgttaaagttagaagacatttgctaagtcaaatcacttcaggaagctcatcctgggagtggaggaacagatgttctgtcattgccacattcttctggacacagactggagaactataggaatgtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaaggtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtgaatctgggaccctccatcaactccaagctgctggggatgtccacccagaactatgccctgatgcaggttgctggccaggaggggacattttctcttgttgctctgccacatgttgcctcagctcagccaattcagaaacccagaatgtccctacctgaaaacctgaaacttcctattcctagatatcaaccccctagaaatagcaaagcatcaagaaagaaacccatcctgatctttcctaagagtggctgtagcaaagctcctgcccaaacccaaatgtgtcctcagatgtccccttccccacctcaccaccctgaactcctgtacaaacccagtccatttgaggaagtaccatcactagagcaagccccagccagcattagcacagctgcgctgaccaatggaagtgaccatggggacttgagaccaccagtgaccaacacccatggcagtctgaaccctcctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttctaactatatgcagtcttattttaaaatacgtactgattcttaatatcttagactttcagaataaataaaaagatcaaaatttgaagattgaaatttagcagaatataggctgttcttcaaatacagctctcagtg

SEQ ID NO: 202540 - DNA, 3344 bp, Homo sapiens
  Payload ID: 19940
  Gene Name: zinc finger protein 438
  Uniprot ID: Q7Z4V0
  ENST ID: ENST00000452305
  CDS Start-End: 565-3021
agggcggagcctgggggcccagcggcccgcgccccgtggcttgacctccccgactgctgggcccgtgacgtcaccccgctgtgacgcgcacgctgtaggaaaactaattaattaaaaggatttacggtatatcttatgactctacaggagccttgggatatagataaaaatgaatgccatttcccatccagtactgaagtgttaaagttagaagacatttgctaagtcaaatcacttcaggaagctcatcctgggagtggaggaacagatgttctgtcattgccacattcttctggacacagactggagaactataggaatgtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaagatccaatcctttgatggcaatggaggaggaggaggacacacgttgcacattctccaaatatccaacagcctttctggatttctcagagtcctatggatagtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtgaatctgggaccctccatcaactccaagctgctggggatgtccacccagaactatgccctgatgcaggttgctggccaggaggggacattttctcttgttgctctgccacatgttgcctcagctcagccaattcagaaacccagaatgtccctacctgaaaacctgaaacttcctattcctagatatcaaccccctagaaatagcaaagcatcaagaaagaaacccatcctgatctttcctaagagtggctgtagcaaagctcctgcccaaacccaaatgtgtcctcagatgtccccttccccacctcaccaccctgaactcctgtacaaacccagtccatttgaggaagtaccatcactagagcaagccccagccagcattagcacagctgcgctgaccaatggaagtgaccatggggacttgagaccaccagtgaccaacacccatggcagtctgaaccctcctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttctaactatatgcagtcttattttaaaatacgtactgattcttaatatcttagactttcagaataaataaaaagatcaaaatttgaagattgaaatttagcagaatataggctgttcttcaaatacagctctcagtg

SEQ ID NO: 202541 - DNA, 3284 bp, Homo sapiens
  Payload ID: 19940
  Gene Name: zinc finger protein 438
  Uniprot ID: Q7Z4V0
  ENST ID: ENST00000538351
  CDS Start-End: 756-3095
attaagctgagaccagaaggctgagtggtggtgacctacaagaagaagaagggaaggtcataacagtaatgacttggagtggagaggccctgcaggttggagaagttcagtgtggctcaccatggagtgtcagagtgagggagatgactgctgagctccgagaggtgaacagagcccctgaattaattaaaaggatttacggtatatcttatgactctacaggagccttgggatatagataaaaatgaatgccatttcccatccagtactgaagtgttaaagttagaagacatttgctaagtcaaatcacttcaggtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaagcaagcaaggagaagcttaggagaaaaaataatggaacaagtatcaggaaagctggactccattccatacctgcctccaaccagctgtggaaccccaggcaaagttattttgcccctgagcctcagttttctcattgaaaaatcgagaatgactaggtgttcctttcaggctctaaaaaggtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtgaatctgggaccctccatcaactccaagctgctggggatgtccacccagaactatgccctgatgcaggttgctggccaggaggggacattttctcttgttgctctgccacatgttgcctcagctcagccaattcagaaacccagaatgtccctacctgaaaacctgaaacttcctattcctagatatcaaccccctagaaatagcaaagcatcaagaaagaaacccatcctgatctttcctaagagtggctgtagcaaagctcctgcccaaacccaaatgtgtcctcagatgtccccttccccacctcaccaccctgaactcctgtacaaacccagtccatttgaggaagtaccatcactagagcaagccccagccagcattagcacagctgcgctgaccaatggaagtgaccatggggacttgagaccaccagtgaccaacacccatggcagtctgaaccctcctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttct

SEQ ID NO: 202542 - DNA, 857 bp, Homo sapiens
  Payload ID: 19940
  Gene Name: zinc finger protein 438
  ENST ID: ENST00000609683
  CDS Start-End: 217-504
aagaaaatgaaactgtcaaatgaaaacaacattggaaggagtacaagagaaaaagatgatacaggaaaaacagtgaggtcatggaaattagacatgagagaggtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaaggtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggtcagatgcccagggccactgaagagaaaactccgcttttcatttagctgtcacttggcccaaaccagtcaaagattcatcaacatcgttgtgaaaatgtcttaaatggacaattcttctagaagacaattaaaataagacagaaaagatgggcaaccgctgaaaaataactaccatcagagtcttcaaatgggacacattccagagttgcattctaaagatggaggaatgggggctcacagccttatctaatctccaaatgaagaatgggcccatctgacatatcctatgagcacaaagcttaggggactcttcaccgaaacctagacaaatatttgaatgcattttttttttttttttttggaaagggagataacgtccaatgggtctgttttataatgcatttgtgtaaggggaacgggaggaaatgagatttaaaaataaaactgtttacttca

SEQ ID NO: 202543 - DNA, 2622 bp, Homo sapiens
  Payload ID: 19941
  Gene Name: zinc finger protein 439
  Uniprot ID: Q8NDP4
  ENST ID: ENST00000304030
  CDS Start-End: 201-1700
gtgagccgagattgcaccattgtactccagcctgggcaataagagtgaaattctgtctcaaaaaaataaaaaaaaaaattgctttatggaagaaagtaagtatagacagagagaaagggatctgatgaccaaagcagggaataaatgtttggagtccacggcatcctgagaacttcttgggaatagagtctaggcccccaatgctgtcactctcacccatcctcctctacacatgtgagatgtttcaggacccagtggcttttaaggatgtggctgtgaacttcacccaggaggagtgggctttgctggatatttcccagaagaatctctacagggaagtgatgctggaaactttctggaacctgacctctataggaaaaaagtggaaagaccagaacattgaatatgagtaccaaaaccccaggagaaacttcaggagtgtcacagaagagaaagtcaatgaaattaaagaagacagtcattgtggagaaacttttaccccagttccagatgacaggctgaacttccagaagaagaaagcttctcctgaagtaaaatcatgtgacagctttgtgtgtgaagttggcctaggtaactcatcttctaatatgaacatcagaggtgacactggacacaaggcatgtgaatgtcaggaatatggaccaaagccatggaagagtcaacaacctaaaaaagccttcagatatcacccctccttgagaacacaagaaagggatcacactggaaagaaaccctatgcttgtaaagaatgtggaaaaaacattatttaccattcaagcattcaaagacacatggtagtgcacagtggggatggaccttataaatgtaagttttgtgggaaagcattccattgtctcagtttatatcttatccatgaaagaactcacactggagagaaaccgtatgaatgtaaacaatgtggtaaatcttttagttattctgctacccatcgaatacatgaaagaactcacattggagaaaagccttatgaatgtcaggaatgtgggaaagcattccatagtcccagatcctgtcacagacatgaaaggagtcacatgggagagaaggcttatcaatgtaaggaatgtggaaaagcattcatgtgtccccgttatgttcgtagacatgaaaggacccactctaggaaaaaactttatgaatgtaagcagtgtgggaaagcattatcctctcttacaagttttcaaacacacataagaatgcactctggagaaagaccttatgaatgtaagacatgtgggaaaggcttttattctgccaagtcatttcaaagacatgaaaaaactcacagtggagagaaaccgtataaatgcaagcaatgtggtaaagccttcactcgttccggttcctttcgatatcatgaaaggactcacactggagagaaaccctatgagtgtaagcaatgtgggaaagccttcagatctgccccaaatcttcaattgcatggtaggactcacactggagagaaaccgtatcaatgtaaggaatgtgggaaagctttcagatctgcctcacaacttcgaatccatcgtaggattcacactggagagaaaccctatgaatgtaagaaatgtgggaaagccttcagatatgtccagaactttcgatttcatgaaaggacacaaacacataagaatgcactctggagaaagaccttataaatataagatatatgggaaacacttttattctgccaagttatttcaaacacatgaaaaaattcacactggagagaaaccctataaatgcaagcaatgtggtaaagccttaattgttccagttcctttcgatatctaaaaggactcacagtggagaaaaactctatgagtgtaagcaatgtgggaaagtcttcagatctgtcaagaacctttcaatttatgaaaggacacacactggagagaaaccctatgaatgtaagaaatgtggaaaagcgttccataatttctcttcttttcaaatacatgaaagttgcacagaggagaggcgccctaagaatgtaagcattgtgggaaagcattcatatctgccaagatcgtttgaatacatgcaaaacacacactggagagaaacctatgaatgtaaggaatgcaaacaagcattcaattatttttcttccttgcatatacatgaaaggactcatacgagagagaatccgtatgaatgtaaggattgtgggaaagcattcagcttgcttaattgctttcatagacatgtaaagacacaccagaaggaaaccctatgaatgtaagcaatgtggcaaaagctttcacttcttccagttcttttcaatatcatgaaaggactcacactggggagaaaccgtatcaatgtaagcaatgtgggaaagccgtcagatcagcctcaagacttcaaatgcatggaagcactcacacttggcagaaactctatgaatgtaagcagtatgggaaagccttcagatcggctaggattctttgaatacaaataatgaatgtaaacaattaactgtttataataactgtatactaacaaatgttattctttttaaataattaagaagctataataaaatatccattggtgtcatgtattagatcaagctta

SEQ ID NO: 202544 - DNA, 605 bp, Homo sapiens
  Payload ID: 19941
  Gene Name: zinc finger protein 439
  ENST ID: ENST00000442091
  CDS Start-End: 252-605
ggccgctggatgtgggtgggccggcagccgggactccgggcgtcctgtcccgtccctgcccgtcgactgcggccttggccccgaagcccttttgtgcagctccgcgcccgcagcccgacgccccagcttgtgcgggggccacgggagggtcatgcgcggatttcgactcgggtgtggatttcgtccgtaggaggagcagcggtctgtggggcccacagcctccactttctcctgttaaaaattatactgagatgtttcaggacccagtggcttttaaggatgtggctgtgaacttcacccaggaggagtgggctttgctggatatttcccagaagaatctctacagggaagtgatgctggaaactttctggaacctgacctctataggaaaaaagtggaaagaccagaacattgaatatgagtaccaaaaccccaggagaaacttcaggagtgtcacagaagagaaagtcaatgaaattaaagaagacagtcattgtggagaaacttttaccccagttccagatgacaggctgaacttccagaagaagaaagcttctcctgaagtaaaatcatgtgacagctttgtgtgtgaagttggcctaggt

SEQ ID NO: 202545 - DNA, 2408 bp, Homo sapiens
  Payload ID: 19941
  Gene Name: zinc finger protein 439
  ENST ID: ENST00000455282
  CDS Start-End: 404-1495
gccgtcacctttgtcgctgcgagggcggcggttgggatctggcctttccagccccgagagggacctagtgcctctacccagatttctgtcgctctgtcacctgcgctatgccctgctttactcacaggagctgtagagaggaccccggtacatctgaaagccgggaaatggaaaaaagtggaaagaccagaacattgaatatgagtaccaaaaccccaggagaaacttcaggagtgtcacagaagagaaagtcaatgaaattaaagaagacagtcattgtggagaaacttttaccccagttccagatgacaggctgaacttccagaagaagaaagcttctcctgaagtaaaatcatgtgacagctttgtgtgtgaagttggcctaggtaactcatcttctaatatgaacatcagaggtgacactggacacaaggcatgtgaatgtcaggaatatggaccaaagccatggaagagtcaacaacctaaaaaagccttcagatatcacccctccttgagaacacaagaaagggatcacactggaaagaaaccctatgcttgtaaagaatgtggaaaaaacattatttaccattcaagcattcaaagacacatggtagtgcacagtggggatggaccttataaatgtaagttttgtgggaaagcattccattgtctcagtttatatcttatccatgaaagaactcacactggagagaaaccgtatgaatgtaaacaatgtggtaaatcttttagttattctgctacccatcgaatacatgaaagaactcacattggagaaaagccttatgaatgtcaggaatgtgggaaagcattccatagtcccagatcctgtcacagacatgaaaggagtcacatgggagagaaggcttatcaatgtaaggaatgtggaaaagcattcatgtgtccccgttatgttcgtagacatgaaaggacccactctaggaaaaaactttatgaatgtaagcagtgtgggaaagcattatcctctcttacaagttttcaaacacacataagaatgcactctggagaaagaccttatgaatgtaagacatgtgggaaaggcttttattctgccaagtcatttcaaagacatgaaaaaactcacagtggagagaaaccgtataaatgcaagcaatgtggtaaagccttcactcgttccggttcctttcgatatcatgaaaggactcacactggagagaaaccctatgagtgtaagcaatgtgggaaagccttcagatctgccccaaatcttcaattgcatggtaggactcacactggagagaaaccgtatcaatgtaaggaatgtgggaaagctttcagatctgcctcacaacttcgaatccatcgtaggattcacactggagagaaaccctatgaatgtaagaaatgtgggaaagccttcagatatgtccagaactttcgatttcatgaaaggacacaaacacataagaatgcactctggagaaagaccttataaatataagatatatgggaaacacttttattctgccaagttatttcaaacacatgaaaaaattcacactggagagaaaccctataaatgcaagcaatgtggtaaagccttaattgttccagttcctttcgatatctaaaaggactcacagtggagaaaaactctatgagtgtaagcaatgtgggaaagtcttcagatctgtcaagaacctttcaatttatgaaaggacacacactggagagaaaccctatgaatgtaagaaatgtggaaaagcgttccataatttctcttcttttcaaatacatgaaagttgcacagaggagaggcgccctaagaatgtaagcattgtgggaaagcattcatatctgccaagatcgtttgaatacatgcaaaacacacactggagagaaacctatgaatgtaaggaatgcaaacaagcattcaattatttttcttccttgcatatacatgaaaggactcatacgagagagaatccgtatgaatgtaaggattgtgggaaagcattcagcttgcttaattgctttcatagacatgtaaagacacaccagaaggaaaccctatgaatgtaagcaatgtggcaaaagctttcacttcttccagttcttttcaatatcatgaaaggactcacactggggagaaaccgtatcaatgtaagcaatgtgggaaagccgtcagatcagcctcaagacttcaaatgcatggaagcactcacacttggcagaaactctatgaatgtaagcagtatgggaaagccttcagatcggctaggattctttgaatacaaataatgaatgtaaacaattaactgtttataataactgtatactaacaaatgttattctttttaaataattaagaagctataataaaatatccattggtgtcatgtattaga

SEQ ID NO: 202546 - DNA, 517 bp, Homo sapiens
  Payload ID: 19942
  Gene Name: zinc finger protein 44
  ENST ID: ENST00000354656
  CDS Start-End: 158-352
gacgttccaggagctagtggcctcttcaccctggtgacctctgttccgtattctgtcactgagagacgccctgggacatctgtggtggcttttgtcgcgctgggacctaccctgactacgggagttgggaggacccgggacaccgcacagccgggaaatggccctgtgttatggaactttctggggctaccctaagatgctggaagctgccaatctcatggagggcctagtggatatcggcccttgggtcactcttcccagaggacagcctgaggtgttggagtggggcctcccaaaggatcaggctggagaacttgggacagtggataagtctggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaa

SEQ ID NO: 202547 - DNA, 2119 bp, Homo sapiens
  Payload ID: 19942
  Gene Name: zinc finger protein 44
  ENST ID: ENST00000355684
  CDS Start-End: 194-2041
aattgtcaatcaggcgcgaggcagagaggagggtgtgacgttccaggagctagtggcctcttcaccctggtgacctctgttccgtattctgtcactgagagacgccctgggacatctgtggtggcttttgtcgcgctgggacctaccctgactacgggagttgggaggacccgggacaccgcacagccgggaaatggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaaggtgtgatgtggtagagagatttggtaaaagtaaagatggtagtcagtgtggagaaaccttaagccagattcgaaatagtattgtaaacaagaacactcccgccagagtagatgcatgtggaagcagtgtgaatggagaagtcataatgggtcattcatccctgaattgctacatcagagttgatactggacacaaacaccgggagtgtcatgaatatgcagagaagtcatatacacataagcagtgtgggaaaggcttaagttatcgccactcctttcaaacatgtgaaaggcctcacactggaaagaaaccctatgattgtaaggaatgtggaaaaaccttcagttctcctggaaaccttcgaagacatatggtagtaaaaggtggagatggaccttataaatgtgaattgtgtgggaaagcctttttttggcccagtttattacgtatgcatgaaagaactcacactggagagaaaccatatgaatgtaagcagtgttctaaagccttccctgtttacagttcctatctaagacatgaaaaaatacacactggggagaaaccgtatgaatgtaagcagtgttctaaagccttccctgattacagttcatatctaagacatgaaagaactcacactggagagaaaccctacaaatgtaaacaatgtgggaaagccttcagtgtttccggttcccttcgagtacatgaaagaattcacactggagagaaaccctatacatgtaaacagtgtgggaaagcgttttgtcatcttggaagctttcaaagacacatgataatgcacagtggagatggacctcataaatgtaagatatgtgggaaaggctttgattttcctggttcagcacgaattcatgaaggaactcacactctagagaaaccctatgaatgtaagcaatgtgggaaattgttatctcatcgctcaagctttcgaagacacatgatggcacacactggagatggccctcataaatgcacagtatgtgggaaagcctttgattctcctagtgtatttcaaagacatgaaaggactcacactggagagaaaccctatgaatgcaagcaatgtgggaaagccttccgtacttccagttcccttcgaaaacatgaaacaacacacactggagagcaaccctataaatgtaaatgtggaaaagcttttagtgatttattttcctttcaaagtcatgaaacaacacacagtgaagaggagccttatgaatgtaaggagtgtgggaaagcatttagttcttttaaatacttttgtcgccatgaaaggactcacagtgaagaaaaatcttatgagtgtcaaatttgtggcaaagccttcagtcgtttcagttacttaaaaactcatgaaaggactcacacggcagagaagccatatgaatgtaagcaatgcaggaaagcattcttttggccctctttccttctaagacatgaaaggactcacactggagaaagaccctatgaatgtaaacactgtggtaaagccttcagtcgttccagtttctgtcgagaacatgaaagaactcacactggagagaagccctatgaatgtaaggaatgtgggaaagccttcagttctctcagttcctttaatagacataaaaggacacactggaaggatattctataagtgtatggaatgtgggaaagcattcattggttttatcacattcagatacttgaaagaaataaatcctgtgaatgtaaa

SEQ ID NO: 202548 - DNA, 2706 bp, Homo sapiens
  Payload ID: 19942
  Gene Name: zinc finger protein 44
  Uniprot ID: P15621
  ENST ID: ENST00000356109
  CDS Start-End: 120-2111
ctctgttccgtattctgtcactgagagacgccctgggacatctgtggtggcttttgtcgcgctgggacctaccctgactacgggagttgggaggacccgggacaccgcacagccgggaaatggccctgtgttatggaactttctggggctaccctaagatgctggaagctgccaatctcatggagggcctagtggatatcggcccttgggtcactcttcccagaggacagcctgaggtgttggagtggggcctcccaaaggatcaggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaaggtgtgatgtggtagagagatttggtaaaagtaaagatggtagtcagtgtggagaaaccttaagccagattcgaaatagtattgtaaacaagaacactcccgccagagtagatgcatgtggaagcagtgtgaatggagaagtcataatgggtcattcatccctgaattgctacatcagagttgatactggacacaaacaccgggagtgtcatgaatatgcagagaagtcatatacacataagcagtgtgggaaaggcttaagttatcgccactcctttcaaacatgtgaaaggcctcacactggaaagaaaccctatgattgtaaggaatgtggaaaaaccttcagttctcctggaaaccttcgaagacatatggtagtaaaaggtggagatggaccttataaatgtgaattgtgtgggaaagcctttttttggcccagtttattacgtatgcatgaaagaactcacactggagagaaaccatatgaatgtaagcagtgttctaaagccttccctgtttacagttcctatctaagacatgaaaaaatacacactggggagaaaccgtatgaatgtaagcagtgttctaaagccttccctgattacagttcatatctaagacatgaaagaactcacactggagagaaaccctacaaatgtaaacaatgtgggaaagccttcagtgtttccggttcccttcgagtacatgaaagaattcacactggagagaaaccctatacatgtaaacagtgtgggaaagcgttttgtcatcttggaagctttcaaagacacatgataatgcacagtggagatggacctcataaatgtaagatatgtgggaaaggctttgattttcctggttcagcacgaattcatgaaggaactcacactctagagaaaccctatgaatgtaagcaatgtgggaaattgttatctcatcgctcaagctttcgaagacacatgatggcacacactggagatggccctcataaatgcacagtatgtgggaaagcctttgattctcctagtgtatttcaaagacatgaaaggactcacactggagagaaaccctatgaatgcaagcaatgtgggaaagccttccgtacttccagttcccttcgaaaacatgaaacaacacacactggagagcaaccctataaatgtaaatgtggaaaagcttttagtgatttattttcctttcaaagtcatgaaacaacacacagtgaagaggagccttatgaatgtaaggagtgtgggaaagcatttagttcttttaaatacttttgtcgccatgaaaggactcacagtgaagaaaaatcttatgagtgtcaaatttgtggcaaagccttcagtcgtttcagttacttaaaaactcatgaaaggactcacacggcagagaagccatatgaatgtaagcaatgcaggaaagcattcttttggccctctttccttctaagacatgaaaggactcacactggagaaagaccctatgaatgtaaacactgtggtaaagccttcagtcgttccagtttctgtcgagaacatgaaagaactcacactggagagaagccctatgaatgtaaggaatgtgggaaagccttcagttctctcagttcctttaatagacataaaaggacacactggaaggatattctataagtgtatggaatgtgggaaagcattcattggttttatcacattcagatacttgaaagaaataaatcctgtgaatgtaaacgtggtaaagccttaagaagtttccaggctgggcgcagcggctcacacctgtaatcccagcactttgagaggccgaggagggcagatcacgaggccaggagatcgagaccagcctggctaacatgggaaaccctgtctctactaaaaatacggaaaaaaaaaaaaatagccaggcatagttgctcacacctgtagtcctagctactcaggaggctgaggcaggagaatcccttgaacccgggaggtggaggttgcagtgagccgagattgcactactgcactccagcttgggtgctagagcgagactccatctcaaaaaaaaaaaaaaaagtttccatttctttcaaatagagttgctgcctgctatatgcaagaagattggttccagtacaccctgagtatacctaaatccacagatgccagctcttttataaaatggaatattcgcatgtacctacccacattctcctgtatactctataaatgtctagattaattaaaatatctcatgcattgt

SEQ ID NO: 202549 - DNA, 3236 bp, Homo sapiens
  Payload ID: 19942
  Gene Name: zinc finger protein 44
  Uniprot ID: P15621
  ENST ID: ENST00000393337
  CDS Start-End: 101-2014
actgagagacgccctgggacatctgtggtggcttttgtcgcgctgggacctaccctgactacgggagttgggaggacccgggacaccgcacagccgggaaatggccctgtgttatggaactttctggggctaccctaagatgctggaagctgccaatctcatggagggcctagtggatatcggcccttgggtcactcttcccagaggacagcctgaggtgttggagtggggcctcccaaaggatcaggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaaggtgtgatgtggtagagagatttggtaaaagtaaagatggtagtcagtgtggagaaaccttaagccagattcgaaatagtattgtaaacaagaacactcccgccagagtagatgcatgtggaagcagtgtgaatggagaagtcataatgggtcattcatccctgaattgctacatcagagttgatactggacacaaacaccgggagtgtcatgaatatgcagagaagtcatatacacataagcagtgtgggaaaggcttaagttatcgccactcctttcaaacatgtgaaaggcctcacactggaaagaaaccctatgattgtaaggaatgtggaaaaaccttcagttctcctggaaaccttcgaagacatatggtagtaaaaggtggagatggaccttataaatgtgaattgtgtgggaaagcctttttttggcccagtttattacgtatgcatgaaagaactcacactggagagaaaccatatgaatgtaagcagtgttctaaagccttccctgtttacagttcctatctaagacatgaaaaaatacacactggggagaaaccgtatgaatgtaagcagtgttctaaagccttccctgattacagttcatatctaagacatgaaagaactcacactggagagaaaccctacaaatgtaaacaatgtgggaaagccttcagtgtttccggttcccttcgagtacatgaaagaattcacactggagagaaaccctatacatgtaaacagtgtgggaaagcgttttgtcatcttggaagctttcaaagacacatgataatgcacagtggagatggacctcataaatgtaagatatgtgggaaaggctttgattttcctggttcagcacgaattcatgaaggaactcacactctagagaaaccctatgaatgtaagcaatgtgggaaattgttatctcatcgctcaagctttcgaagacacatgatggcacacactggagatggccctcataaatgcacagtatgtgggaaagcctttgattctcctagtgtatttcaaagacatgaaaggactcacactggagagaaaccctatgaatgcaagcaatgtgggaaagccttccgtacttccagttcccttcgaaaacatgaaacaacacacactggagagcaaccctataaatgtaaatgtggaaaagcttttagtgatttattttcctttcaaagtcatgaaacaacacacagtgaagaggagccttatgaatgtaaggagtgtgggaaagcatttagttcttttaaatacttttgtcgccatgaaaggactcacagtgaagaaaaatcttatgagtgtcaaatttgtggcaaagccttcagtcgtttcagttacttaaaaactcatgaaaggactcacacggcagagaagccatatgaatgtaagcaatgcaggaaagcattcttttggccctctttccttctaagacatgaaaggactcacactggagaaagaccctatgaatgtaaacactgtggtaaagccttcagtcgttccagtttctgtcgagaacatgaaagaactcacactggagagaagccctatgaatgactcagtgacctttgaagatgtggctgtgaacttcacccaggaggaatggactttgctggatccttcacagaaaaaactctacagagacgtgatgtgggaaaccttcaggaacctggccactataggaacaaaacaaaaagaatggaacattgaagagcagtacaaaaaccaggggagaaatctcagaaatcatatggtagagagactctgtgaaagtaaagaaggtagtcatggcggagaaggtttcagccagattgcaaatctcagtctgaacaagaaaactccttctggaggaaagctttgggaaagcagtgtatgtggaaaagtcttgagccatcattcatcccttaacaggcacattagatcttacaccagacacaaactgtataagtgtcaggaatatggagagaagccatataaatgtaagaaatgtgggaaacccttcagttatctgcagtcttttaaaaaacataaaagaacacacagtgcagggatagtctacaaatgtaaggcctgtgggaaagccttcagttgtcaacgttctttccaaatacatggaaggactcacactggagataaaccctttaagtgtaaagaatgtggaaaagcattccgataccaccaatctgctcaaaaacatgaaaaggctcatactggagagaaaccctacaaatgtaaggaatgtgggaaacccttcatttaccgccattctgctcgagcacatgaaaggaatcacactgtacagaaacgctatgaatgtaaacaatgtggaaaaacctacatatcttctgtaggttttcaagcacatgaaagaactcacactggagaaaaaccctatgaatgtaaaaaatgtgggaaagtgttcgtatatcacaactctgctcaaagacatgaaaagactcatactggagagaaaccctacaaatgcaaggaatgtgggaaagccttcagttaccactgtactgctcaaaaacatgagaggaatcacactgcacagaaacactatgaatgtaaactgtgtgggaaaacttacttgtctcctttaggttttcaagcacatgaaagtactcacactggagataaaccctttgagtgtaaaaaatgtggaaaagcatttagatactactactcagctcaaagacatgaaaggactcatactggagagaaaccctacaaatgtaaggaatgtgggaaagccttttattgttgcagttctgcccga

SEQ ID NO: 202550 - DNA, 2372 bp, Homo sapiens
  Payload ID: 19942
  Gene Name: zinc finger protein 44
  Uniprot ID: P15621
  ENST ID: ENST00000397742
  CDS Start-End: 141-1910
tggcctcttcaccctggtgacctctgttccgtattctgtcactgagagacgccctgggacatctgtggtggcttttgtcgcgctgggacctaccctgactacgggagttgggaggacccgggacaccgcacagccgggaaatggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaaggtgtgatgtggtagagagatttggtaaaagtaaagatggtagtcagtgtggagaaaccttaagccagattcgaaatagtattgtaaacaagaacactcccgccagagtagatgcatgtggaagcagtgtgaatggagaagtcataatgggtcattcatccctgaattgctacatcagagttgatactggacacaaacaccgggagtgtcatgaatatgcagagaagtcatatacacataagcagtgtgggaaaggcttaagttatcgccactcctttcaaacatgtgaaaggcctcacactggaaagaaaccctatgattgtaaggaatgtggaaaaaccttcagttctcctggaaaccttcgaagacatatggtagtaaaaggtggagatggaccttataaatgtgaattgtgtgggaaagcctttttttggcccagtttattacgtatgcatgaaagaactcacactggagagaaaccatatgaatgtaagcagtgttctaaagccttccctgtttacagttcctatctaagacatgaaaaaatacacactggggagaaaccgtatgaatgtaagcagtgttctaaagccttccctgattacagttcatatctaagacatgaaagaactcacactggagagaaaccctacaaatgtaaacaatgtgggaaagccttcagtgtttccggttcccttcgagtacatgaaagaattcacactggagagaaaccctatacatgtaaacagtgtgggaaagcgttttgtcatcttggaagctttcaaagacacatgataatgcacagtggagatggacctcataaatgtaagatatgtgggaaaggctttgattttcctggttcagcacgaattcatgaaggaactcacactctagagaaaccctatgaatgtaagcaatgtgggaaattgttatctcatcgctcaagctttcgaagacacatgatggcacacactggagatggccctcataaatgcacagtatgtgggaaagcctttgattctcctagtgtatttcaaagacatgaaaggactcacactggagagaaaccctatgaatgcaagcaatgtgggaaagccttccgtacttccagttcccttcgaaaacatgaaacaacacacactggagagcaaccctataaatgtaaatgtggaaaagcttttagtgatttattttcctttcaaagtcatgaaacaacacacagtgaagaggagccttatgaatgtaaggagtgtgggaaagcatttagttcttttaaatacttttgtcgccatgaaaggactcacagtgaagaaaaatcttatgagtgtcaaatttgtggcaaagccttcagtcgtttcagttacttaaaaactcatgaaaggactcacacggcagagaagccatatgaatgtaagcaatgcaggaaagcattcttttggccctctttccttctaagacatgaaaggactcacactggagaaagaccctatgaatgtaaacactgtggtaaagccttcagtcgttccagtttctgtcgagaacatgaaagaactcacactggagagaagccctatgaatgactcagtgacctttgaagatgtggctgtgaacttcacccaggaggaatggactttgctggatccttcacagaaaaaactctacagagacgtgatgtgggaaaccttcaggaacctggccactataggaacaaaacaaaaagaatggaacattgaagagcagtacaaaaaccaggggagaaatctcagaaatcatatggtagagagactctgtgaaagtaaagaaggtagtcatggcggagaaggtttcagccagattgcaaatctcagtctgaacaagaaaactccttctggaggaaagctttgggaaagcagtgtatgtggaaaagtcttgagccatcattcatcccttaacaggcacattagatcttacaccagacacaaactgtataagtgtcaggaatatggagagaagccatataaatgtaagaaatgtgggaaacccttcagttatctgcagtcttt

SEQ ID NO: 202551 - DNA, 2051 bp, Homo sapiens
  Payload ID: 19942
  Gene Name: zinc finger protein 44
  ENST ID: ENST00000600003
  CDS Start-End: 129-593
cctggtgacctctgttccgtattctgtcactgagagacgccctgggacatctgtggtggcttttgtcgcgctgggacctaccctgactacgggagttgggaggacccgggacaccgcacagccgggaaatggccctgtgttatggaactttctggggctaccctaagatgctggaagctgccaatctcatggagggcctagtggatatcggcccttgggtcactcttcccagaggacagcctgaggtgttggagtggggcctcccaaaggatcaggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaaggttatcggagacatggttacagaatttcattttgatccattatggtcacctggtagctttgtctgatggaggtttgttacagttttcaacaggacagggtctccctgtcacccaggctggagttcagtagtgttctcttggctcactgaaactgctgcctcccaagcaaatgatcctcccacctcagcctcctgaatagctgggactacaggtgcacactaccatgcccagactgagataaggtatgaggaagccttggccatgccaccagccgcttatcccaaattcctgatccctggaagacatctgggctctccctcctgttccagcccagtagcttccagcaaaggtactggctcaattggacacggagtgtggaactgcctgctcacacttgtgaacccccgtccagaaggaagaaacagaaagggcccaccttccagaggccgaggtggctccaccacagcttctgtccggtggtgaccagcactgatctccggagccaagggaggacccgggacacctgggagccgggaaatgttttccatggctccgagacaatgacaccgcttcagtgtgaactctcatgaattgagtctagatccccagtgctgtccgtctcacctgtcctcctctacacatatctgggatatgtcacggcttggtggtctttgaagatgtgactctgaacttcatccagaaggagtaggctttgctggatttttccgtgaagaatctgtagagatgtgatgagggaagccatcagcacctggcttctatagctgcagcccaagaggccaactggaacgttaacatcagacactaatccagctgactggacacaattgggaaaactggttattttaccaaggctttaactggaatggtgtgccttcctttaaggaatcaaatttgacttatggagccaataaagcccttggaaagctggcctcagatttcatgtacagtccctgtacagggtttccgatctgtgagattttttaaactgacaggatcatggccatttcacagacaactacccaaaaatatctacagacggcactgctcctaccaacccgataccagagaactctctgtcccctcgtcagcaggaagtagccagaaagaacatgccgcccctcgtcctttttataactatgaggtctggattgacagagcagaagcatcaccattgtggataagcgcctcattttaaaattcaccttaatcaaaaactgcctaaatccaaagggcatcagcctaatggctaaggtcagcatgatcacaaaccacaaataacatctccaaccaaaaacattccagacacctcccacagagaaatgctagcctcgggataacccctctcctgccggaaagatgtcacccccaagataaccacccctccgcccagaacattccaaccctgccacaaacttctcccccacacagaaacattccaagcttgtaataagctccctcaccctaaaaccaacgtacattcttagtctgcaaggaaaagtgctcctgactgaccagccagaatcctctctcaggtcttttctataataaacctgtctttgactgtcaa

SEQ ID NO: 202552 - DNA, 4189 bp, Homo sapiens
  Payload ID: 19943
  Gene Name: zinc finger protein 440
  Uniprot ID: Q8IYI8
  ENST ID: ENST00000304060
  CDS Start-End: 165-1952
attcctttagtgctgcgccgacagcggtcaggatctcggctttcttgcttcgagagggactaggtgcctccaccagagcttctgtcgctctgtaacctgcactgtgacctacactagtcgcgggagccacgcagaggacgccggaacaccctggaagccgagaaatggacccagtggcttttaaggatgtggctgtgaacttcacccaggaggagtgggctttgctggatatttcccagaggaaactctacagggaagtgatgctggaaactttcaggaacctgacctctttaggaaaaaggtggaaagaccagaacattgaatatgagcaccaaaaccccaggagaaacttcaggagtctcatagaagaaaaagtcaatgaaattaaagatgacagtcattgtggagaaacttttaccccagttccagatgacagactgaacttccaggagaagaaagcttctcctgaagtaaaatcatgtgaaagctttgtgtgtggagaagttggcctaggtaactcatcttttaatatgaacatcagaggtgacattggacacaaggcatatgagtatcaggaatatggaccaaagccatgtaagtgtcaacaacctaaaaaagccttcagataccgcccctcctttagaacacaagaaagggatcacactggagagaaacccaatgcttgtaaagtatgtggaaaaacctttatttcccattcaagtgttcgaagacacatggtaatgcacagtggggatggaccttataaatgtaagttttgtgggaaagcattccattgtctcagattatatcttatccatgaaagaattcacactggagagaaaccatgtgaatgtaaacagtgtggtaaatcctttagttattctgctacccatcgaatacataaaagaactcacactggagaaaagccttatgaatatcaggagtgtgggaaagcatttcatagtcccagatcctatcgtagacatgaaaggattcacatgggagaaaaggcttatcaatgtaaggaatgtggaaaagcattcacgtgtccccgttatgttcgtatacatgaaaggacccactctaggaaaaatctctatgaatgtaagcagtgtgggaaagcattatcctctcttacaagttttcaaacacacgtaagattgcactctggagaaagaccttatgaatgtaagatatgtggaaaagacttttgttctgtgaattcatttcaaagacatgaaaaaattcacagtggagagaaaccctataaatgtaagcagtgtggtaaagccttccctcattccagttcccttcgatatcatgaaaggactcacactggagagaaaccctatgagtgtaagcaatgtgggaaagccttcagatctgcctcacaccttcgagtgcatggtaggactcacactggagagaaaccgtatgaatgtaaggaatgtgggaaagccttcagatatgtgaataaccttcaaagtcatgaaaggacacaaacacacataagaatacactctggagaaagacgttataaatgtaagatatgtgggaaaggcttttattgtcccaaatcatttcaaagacatgaaaaaactcacactggagagaaactctatgaatgcaagcaacgttcagtagttccttcagtagttccagttccttttgatatcatgaaaggactcacactggagagaagccctataaatgcgagcaatgtgggaaagccttcagagctgtgtcaatcctttgaatgcatggtaggactcaccctgaagagaaaccctatgagtgtgagcaatgacggaaagccttcagatctgccccacacctttgaatacgtggtaggacacacaatggagagaagccctatgcatgtaaggaatgtgggaaacccttcggatctgcccagaaccttcgaattcatgaaaggacacaaacacacataatgcactctgtagagagaccttataaatgtaagatatgtgggaggggcttttattctgccaagtcatttcaaatacatgaaaaatcttacactggagagaaaccctatgagtgtaagcaatgtgggaaagcctttgtttccttcacttcctttcgatatcatgaaaggactcacactggagagaacccctatgagtgtaagcaatttgggaaagccttcagatctgtcaaaaatcttcgatttcataaaaggacacacactggagagaaaccctgtgaatgtaagaaatgtagaaaagcattccataatttctcttctttgcaaatacatgaaaggatgcacagaggagagaagctctgtgaatgtaagcattgtgggaaagcattcatatctgccaagatcctttgaatacatgcaagaacacacaatggagagaaaccctatgaatgtaaagaatgcagaaaagcattcagcttgcctacttcctttcatagacatgaaaagactcacactggaaggaaacactatgaatgcaagcaatgtggcaaagctttcacttcttccagttcttttcaatatcatgaaagaacacactagggagaaaccctatcaatgtaagcaatgtgcaaaagcctttatttcttccacttcttttcaatatcatgaaaggactcacatgggagagaaaccctatgagtgtatgccaagtgggaaagccttcatttcttctagttcccttcaatatcatgaaaggactcacactggagagaagccctatgaatataagcaatgtgggaaagccttcagatcagcctcgcaccttcaaatgcatggaaggactcacactggagaaaaaccctatgaatgtaagcagtatgggaaagcgttcagacctgacaagattctttgaatacagataatgaatgtaaacaattaactgtttataataactgtatactaacaaatgatattctttttaaataagaagctataatatcccattggtgtcatgtattagatcagccttatactgttaaattgttattatttggacattgtgagtcagtataaccatgtggataaaatgccagacatctttttattcgaaaattttacttttcatgcttctgtacttacatttttatctcaaccttaatttttctttctttttttttttcccccagaaagaatctcactctgtcacccaggctggagtgcagtggcatgatctcaggtcactgcaacctctgcctccagggttcaagcaattctcctgcctcagtctcctgagtagctgggactacaggcatgcgccaccatgccaggctaattttttgtattttttagtagagacggggtttcaccatattggctaggctggtctcaaactccagacctcatgatttacccacctcggcctcccaaaatgctgggattacagacatgaaccatcatgcccagctgcaaccctaatttttcattcagtcataataccaatagttatctcatgcacctctgagtgccttcttccccaaaaccagcagtgccatacctgctgtcagcaagggtgtaatataccatagtgataaatatgaccaaaagccataaatgactgtgagatgtatgagaattacaagtcacattagtaagaagagaaaaattttggtcatgtttatgatttgaaatacgttttcctctatcacatttaaaaatatagttacaaaatgcccttgtttttgtcctgattcatcatggtcactgaggagcatcgtctcatatgcctggtatgtgacacgtgtctctccaacaataaaagacttggccttggctgggcatggtggctcacgcctgtaatcccagcactttgggaggccgaggtcaggagttagagaccattctgaccaatatgatcaaaccccgtctctactaaaaatacaaaagttagcagggcgtggtggcatgctcctgtaatcctagctattcaggaggctgacataggagaattgcttgaatataggaagcagaggttgcagtgagccgaggttgcaccattgtactccagcctgggcaacaagagtgaaactctgtcttaaaaaacacaaaaaaagacttggccttagggccgagtgcggtggctcacgcctataatcccagcactttgggaggccgaggcgggcggatcactaggtcaggaaatggagaccatcctggccaacacagtgaaacccagtctctact

SEQ ID NO: 202553 - DNA, 920 bp, Homo sapiens
  Payload ID: 19943
  Gene Name: zinc finger protein 440
  ENST ID: ENST00000427505
  CDS Start-End: 105-920
taggtgcctccaccagagcttctgtcgctctgtaacctgcactgtgacctacactagtcgcgggagccacgcagaggacgccggaacaccctggaagccgagaaatgatgtttcaggacccagtggcttttaaggatgtggctgtgaacttcacccaggaggagtgggctttgctggatatttcccagaggaaactctacagggaagtgatgctggaaactttcaggaacctgacctctttaggaaaaaggtggaaagaccagaacattgaatatgagcaccaaaaccccaggagaaacttcaggagtctcatagaagaaaaagtcaatgaaattaaagatgacagtcattgtggagaaacttttaccccagttccagatgacagactgaacttccaggagaagaaagcttctcctgaagtaaaatcatgtgaaagctttgtgtgtggagaagttggcctaggtaactcatcttttaatatgaacatcagaggtgacattggacacaaggcatatgagtatcaggaatatggaccaaagccatgtaagtgtcaacaacctaaaaaagccttcagataccgcccctcctttagaacacaagaaagggatcacactggagagaaacccaatgcttgtaaagtatgtggaaaaacctttatttcccattcaagtgttcgaagacacatggtaatgcacagtggggatggaccttataaatgtaagttttgtgggaaagcattccattgtctcagattatatcttatccatgaaagaattcacactggagagaaaccatgtgaatgtaaacagtgtggtaaatcctttagttattctgctacccatcgaatacataaaagaactcacactggagaaaagccttatgaatatcaggagtgtgggaaagcatttcatagtcccaga

SEQ ID NO: 202554 - DNA, 559 bp, Homo sapiens
  Payload ID: 19943
  Gene Name: zinc finger protein 440
  ENST ID: ENST00000457526
  CDS Start-End: 401-559
cctttagtgctgcgccgacagcggtcaggatctcggctttcttgcttcgagagggactaggtgcctccaccagagcttctgtcgctctgtaacctgcactgtgacctacactagtcgcgggagccacgcagaggacgccggaacaccctggaagccgagaaatggaaaaaggtggaaagaccagaacattgaatatgagcaccaaaaccccaggagaaacttcaggagtctcatagaagaaaaagtcaatgaaattaaagatgacagtcattgtggagaaacttttaccccagttccagatgacagactgaacttccaggagaagaaagcttctcctgaagtaaaatcatgtgaaagctttgtgtgtggagaagttggcctaggtaactcatcttttaatatgaacatcagaggtgacattggacacaaggcatatgagtatcaggaatatggaccaaagccatgtaagtgtcaacaacctaaaaaagccttcagataccgcccctcctttagaacacaagaaagggatcacactggagagaaacccaatgcttgtaaa

SEQ ID NO: 202555 - DNA, 796 bp, Homo sapiens
  Payload ID: 19943
  Gene Name: zinc finger protein 440
  ENST ID: ENST00000414255
  CDS Start-End: 289-796
gtggcatatgcctgtaatcttagctactcaggaggctgaggaagaagaagtgctagaaccccggcagtgagccgagatcatgccattgcactgcagcctgggcaacaagagtgaaaaaaaaaacaagttgctttgtggaagaaagtaagtatacacagggagaaagagatctgatgaccaaagcagggaatacgtgtttggagtccacggcatcctgagaacttcttgggaatagagtctaggcccccagtgctgtcactctcacccatcttcttctacacatgtgagatgtttcaggacccagtggcttttaaggatgtggctgtgaacttcacccaggaggagtgggctttgctggatatttcccagaggaaactctacagggaagtgatgctggaaactttcaggaacctgacctctttaggaaaaaggtggaaagaccagaacattgaatatgagcaccaaaaccccaggagaaacttcaggagtctcatagaagaaaaagtcaatgaaattaaagatgacagtcattgtggagaaacttttaccccagttccagatgacagactgaacttccaggagaagaaagcttctcctgaagtaaaatcatgtgaaagctttgtgtgtggagaagttggcctaggtaactcatcttttaatatgaacatcagaggtgacattggacacaaggcatatgagtatcaggaatatggaccaaagccatgtaagtgtcaacaacctaaaaaagccttcagataccgcccctcctttagaacacaagaaagggatcacactg

SEQ ID NO: 202556 - DNA, 556 bp, Homo sapiens
  Payload ID: 19943
  Gene Name: zinc finger protein 440
  ENST ID: ENST00000588954
  CDS Start-End: 409-556
agaagaattgcttgaacccaggaggcggcggttgcagtcagccaagacggcgtcactccagcctggcaacagagccagactccatctcaaaacaacaacaacgattcacgaatgagaaacacccagtcctggcttgtggtttgtcaacggaaaaagccaagctatgtaaaataaagaagtttattaggagccgaataggagagccgttggccgagggaaacacaaccccaagcagcctggaatcatgctttttgtgttgtgtgtgaaatcttattgccaaatcaaggtcgtcttggttttgacaagtgtgaaattgacccagtggcttttaaggatgtggctgtgaacttcacccaggaggagtgggctttgctggatatttcccagaggaaactctacagggaagtgatgctggaaactttcaggaacctgacctctttaggaaaaaggtggaaagaccagaacattgaatatgagcaccaaaaccccaggagaaacttcaggagtctcatagaagaaaaagtcaatgaaattaaagatgacagtcattgtggag

SEQ ID NO: 202557 - DNA, 4356 bp, Homo sapiens
  Payload ID: 19944
  Gene Name: zinc finger protein 441
  Uniprot ID: Q8N8Z8
  ENST ID: ENST00000357901
  CDS Start-End: 103-2184
actgagagacgccctggaacgtctgtggcagcttctgtctcgctgggacccgcactgacagcgggaggcagagggaggaacctggacgccggaagccgggaaatggactcagtggcatttgaggatgtggctataaacttcacctgtgaggagtgggctttgctgggtccatcacagaagagtctctacagagatgtgatgcaggaaaccatcagaaacctggactgtataggaatgatatggcaaaatcatgatatagaagaagatcagtacaaagatctcagaagaaatctaagatgtcatatggtagagagagcctgtgaaattaaagataatagtcaatgtggaggaccctttacccagactcaagacagtattgtgaacgagaaaatacctggagtagatccatgggaaagcagtgagtgtacagacgtcctcatgggtcgttcatctcttaattgctacgttagagttgacagtgaacacaaaccatgtgagtatcaagaatatggagagaagccatatacacatacacaatgtgggacagctttcagttatcagccctgctttcaaatacatgaaagacctcagcatggaaagaaactctatgattgtaaggaatgtgcaagcttcagttctcttgaaaaccttcaaagacacatggcagcacaccatggagatggacctcgtatatgtaagttgtgtggaaacgcctttatttggcctagtttatttcatatgcttagaagaactcacactgaagagaaaccatatgaatatgagcagtgttctacagcgtttcctgcttatagttccactctaagacatgaaagaacacacagtggagagaaaccctatcaatgtaaacaatgtgggaaagccttcagttgttcctgttacactcaactatatgaaaggactcacactggagaacaatcctatgaatgtaagcaatgtgggaaagcattttatcatcttggaagctttcaaagacacatgatagtgcacactggagatgggcctcataaatgtaagatatgtggaaaaggctttctttctcccagttcagttcgaagacataaaagaactcacactggagagaaaccgtatgaatgtaagtattgtgggaaagcattctctgattgcacaggttttcgaagacacatgataacgcacactggagatggacctcataaatgcaaggtatgtgggaaagcctttgattctcccagtttatgtcgaaggcatgaaacaactcatactggggagaaaccctataaatgtgaatgtgggaaagcctttagtgatttctattactttcgaaatcatgaaactactcacactggagagaagccatataaatgtaaacaatgtggaaaagccttcatttgttgcacttaccttcaaatacatgaaagaattcacactggggagagaccctataaatgtaaacaatgcggaaaagccttcaggtcttccaattacattcgagtacatgaaaagactcacactggagaaaagccctatgaatgtaagcagtgtggaaaagcactttctcatctgaaaagctttcagagacacatgataatgcacactggagatggacctcataaatgtaagatatgtgggaaaagctttgattctcccagttcatttcgaagacatgaaagaattcacactggggagagaccctataagtgtaaactatgtgggaaaggcttcaggtcttccagttacattcaactacatgaaaggactcacactggagagaaaccctatggttgtcagcaatgtgggaaagcattatctgatctctcaagctttcgaagacacatgataacacatactggaaatggacctcataaatgtaagatatgtgggaaaggctttgattatcccagttcagtgcaaagacatgaaagaactcacactggagagaaaccctatgaatgcaaggaatgtggtaaagccttcagtcattcaagttacttacgaatacacgaaagagttcatactggagagaagccgtataaatgtaaggaatgtgggaaaccattccattgtcccagtgcctttcataaacatgaaaggacccacagtatggagaaaccctataagtgtaaagaatgtggggaagcatttcattgtatcagttcctttcataaacatgaaatgactcactagagaaaacccctatgagtgttgaacatgtgagaaagccttaagtactttcagcttcttacaaatacataagagactcacactgaaaaaagttgtatgaatataaaaatgtactaaaaccttccatttttttcagtaccttttgaaaacatgaccaaactcatacttcaaaaatatatatataatgaatgtgaggaatatgaaaaaactttctttgtctagcaaactttcaaaggtggttattataacatactagcaatggaccttactactgtaaggaatgtagaaatgcatttactagtcctaattcatttcagttacatgaaagatttcaaactgcagagaaccactatgaatgtaaacaatgtggtaaagcatttagtagcttcagtttcttttgaatacagtcttctctagtttctgaggtgaattgattccagcaccctcaggaatacctatattcagagatattcaagtccctgatattaaaaacagcatatttgcatataatctaggcacatttttctgtatatcttaaatcatttctagattacttataatacacaatgcattgtaaattctgtataagttgcttttgtattatttagggaatcatgacaagaaaaaagtctacatgttcagtacaaatacaactgtcattcattgtcctaagtacgtgtacatgtcagcaacaatgtcaggatctgtggagtttgcgagtataagatctttaagtgttgaaggtttcatctccataattgcagctgctttagctacaaatattataggaagctgttccttctttttctttacatcaccaaaccttccagtggttataggcattttgttatccttcaagtgacctggagcctttgttgcatgacaggattgtacctgaagatcacattctttaacaattggacctactgaatctgtaaaactactagaagaaaacatattgaaaatacttcaggacattggtttaggcaaagattttatggctaatacctcaaagcacagacaacaaagataaaaatagacaaatgagactatcttacactaaaaagtagctgtgcaaagtaaagggaacaacaagagtgcagagaaaacctgttgaatatgagagaatatttgcaaactatgcgacaagggactaatatccaaatatacaaggaactcaaacatctcaacagcaaaaaatataaataatcccattaaagtgggaaaaggatgtgaacagacagttctcaaaagaagacatgcaaatggccaaaaagtatatggaaatatgttcaacatcactaatgattaggaaaatgcaaattgaaaccacaatgagatactctacttagaattgttcttactaaaaaagataaaaaacaacaaatgctgatgaggatgtggagaaaagaaaactttcactgttggtgaaagtataaattagaacaactactgtggaaaacagtatgtagatttctcaaaaacctaaaaatagaaccaccacatgatccagcaaaccaagtataaccacaggaaaagaaatcagtatatcaaagagatacttgcacttgcatatttatcacagcactattcatgataacaaagatatggaattaacctaagcatccatcagtggacacagggataaagaaaatgtttatgtacacagtggaatactatttggccataaaaaagagtaaaatgttattgctaacaacatggatggaacttgaggtcattatggtaagtgaaataagccaggcacagaaagacaaataccacatgttctcacttatatgtgggaggtgaaaaacttcacctcatggagatagggaatagaataagttatccggggctgagaaggggaaatgaagagaaattggtgaatatgtacaaatttccatttagatcaaaggaataagttctgatgttagaaagcatactagagtgaactatagttagcaaaaatatattgcatatttcaaagtagttggaagagaggacttgaaatgttaccaacacatagaagtggtaaatactcaagatcatggataccccaaatacgctgacttgaccattacacattctatgcatgcaagaaatgctcatgtgtaccttatatatatgtaaaatatgtatcaataaaagaaaatatataagatagttttaaaataa

SEQ ID NO: 202558 - DNA, 2828 bp, Homo sapiens
  Payload ID: 19944
  Gene Name: zinc finger protein 441
  ENST ID: ENST00000409902
  CDS Start-End: 103-237
actgagagacgccctggaacgtctgtggcagcttctgtctcgctgggacccgcactgacagcgggaggcagagggaggaacctggacgccggaagccgggaaatggactcagtggcatttgaggatgtggctataaacttcacctgtgaggagtgggctttgctgggtccatcacagaagagtctctacagagatgtgatgcaggaaaccatcagaaacctggactgtatagactgaataagaggaggggttggtcttgctgtctcaagagtagcagagactgaagaaattcatatgaatgatatggcaaaatcatgatatagaagaagatcagtacaaagatctcagaagaaatctaagatgtcatatggtagagagagcctgtgaaattaaagataatagtcaatgtggaggaccctttacccagactcaagacagtattgtgaacgagaaaatacctggagtagatccatgggaaagcagtgagtgtacagacgtcctcatgggtcgttcatctcttaattgctacgttagagttgacagtgaacacaaaccatgtgagtatcaagaatatggagagaagccatatacacatacacaatgtgggacagctttcagttatcagccctgctttcaaatacatgaaagacctcagcatggaaagaaactctatgattgtaaggaatgtgcaagcttcagttctcttgaaaaccttcaaagacacatggcagcacaccatggagatggacctcgtatatgtaagttgtgtggaaacgcctttatttggcctagtttatttcatatgcttagaagaactcacactgaagagaaaccatatgaatatgagcagtgttctacagcgtttcctgcttatagttccactctaagacatgaaagaacacacagtggagagaaaccctatcaatgtaaacaatgtgggaaagccttcagttgttcctgttacactcaactatatgaaaggactcacactggagaacaatcctatgaatgtaagcaatgtgggaaagcattttatcatcttggaagctttcaaagacacatgatagtgcacactggagatgggcctcataaatgtaagatatgtggaaaaggctttctttctcccagttcagttcgaagacataaaagaactcacactggagagaaaccgtatgaatgtaagtattgtgggaaagcattctctgattgcacaggttttcgaagacacatgataacgcacactggagatggacctcataaatgcaaggtatgtgggaaagcctttgattctcccagtttatgtcgaaggcatgaaacaactcatactggggagaaaccctataaatgtgaatgtgggaaagcctttagtgatttctattactttcgaaatcatgaaactactcacactggagagaagccatataaatgtaaacaatgtggaaaagccttcatttgttgcacttaccttcaaatacatgaaagaattcacactggggagagaccctataaatgtaaacaatgcggaaaagccttcaggtcttccaattacattcgagtacatgaaaagactcacactggagaaaagccctatgaatgtaagcagtgtggaaaagcactttctcatctgaaaagctttcagagacacatgataatgcacactggagatggacctcataaatgtaagatatgtgggaaaagctttgattctcccagttcatttcgaagacatgaaagaattcacactggggagagaccctataagtgtaaactatgtgggaaaggcttcaggtcttccagttacattcaactacatgaaaggactcacactggagagaaaccctatggttgtcagcaatgtgggaaagcattatctgatctctcaagctttcgaagacacatgataacacatactggaaatggacctcataaatgtaagatatgtgggaaaggctttgattatcccagttcagtgcaaagacatgaaagaactcacactggagagaaaccctatgaatgcaaggaatgtggtaaagccttcagtcattcaagttacttacgaatacacgaaagagttcatactggagagaagccgtataaatgtaaggaatgtgggaaaccattccattgtcccagtgcctttcataaacatgaaaggacccacagtatggagaaaccctataagtgtaaagaatgtggggaagcatttcattgtatcagttcctttcataaacatgaaatgactcactagagaaaacccctatgagtgttgaacatgtgagaaagccttaagtactttcagcttcttacaaatacataagagactcacactgaaaaaagttgtatgaatataaaaatgtactaaaaccttccatttttttcagtaccttttgaaaacatgaccaaactcatacttcaaaaatatatatataatgaatgtgaggaatatgaaaaaactttctttgtctagcaaactttcaaaggtggttattataacatactagcaatggaccttactactgtaaggaatgtagaaatgcatttactagtcctaattcatttcagttacatgaaagatttcaaactgcagagaaccactatgaatgtaaacaatgtggtaaagcatttagtagcttcagtttcttttgaatacagtcttctctagtttctgaggtgaattgattccagcaccctcaggaatacctatattcagagatattcaagtccctgatattaaaaacagcatatttgcatataatctaggcacatttttctgtatatcttaaatcatttctagattacttataatacacaatgcattgtaaattctg

SEQ ID NO: 202559 - DNA, 6219 bp, Homo sapiens
  Payload ID: 19945
  Gene Name: zinc finger protein 442
  Uniprot ID: Q9H7R0
  ENST ID: ENST00000242804
  CDS Start-End: 584-2467
gaagccctggcaggtcagtggcaggcactgtcacgctgagtcctatgctggcagcggggaaccttggggagaacacgggacaccgcggaagccgggaaatgattgtgcggctgtaaccggcacaggttcgcggtccgagtcactgcaccgagactccaaggcctgcagcagaaacagtttaatagggggagaggagagaagaccccagttccgcctccatgagaggtttggggatgggggtgtttaggggtctggacaggggcggctgaagtgtggggtcgctggttggtggggaagtgacaggcgaatcctgggacgggaggtgaagaaaccgcattctcctgctgagtgggttccctcgtggggttttcaccctgcttggcgccagcctttccgttggaattcaagatctgagaaagaacttgggcaactcgagcagctctccgagatcttatccccaggcacaatgcagaagccggcggtcagtgtcttctgtgacctgactctcaggaaggcggcccccgcgaggcagtggggctcaggtttccattccttggggacacacggctggtcagccagttgaatgattgtatttgggggagaagacagaagtgatctcttccttcctgactctcagactaatgaagagagaaaacaatatgattcagtagcctttgaggatgtggcggtgaacttcacccaggaagagtgggctttgctgggtccatcacagaagagtctgtacagagatgtgatgtgggaaaccattaggaacctggactgtataggaatgaaatgggaagacacaaacattgaagatcagcacagaaatcccaggaggagcctaagatgtcatatcatagagagatttagtgaaagtcgccagccagatagtactgtgaatgaaaaacctcctggagtagatccatgtaaaagcagtgtgtgtggagaaatcatgggttgttcattccttaattgctatatcacatttgatgctggacacaaaccagatgagtgtcaggaatatggagagaagccacatacacataaacaatgtgggacagccttcaattatcaccactcctttcaaacacaggaaagacctcacactggaaagaaacgctatgattgtaaggaatgtgggaaaaccttcagttcttcgggaaaccttcgaagacacataatagtacaacgtggaggtggaccttatatatgtaagttgtgtgggaaagcctttttttggcctagtttatttcgtatgcatgaaagaactcacactggagagaaaccgtatgaatgtaagcagtgttgtaaagccttccctatttacagttcctatctaagacatgaaagaacacacactggggagaaaccatatgaatgcaagcactgttccaaagccttccctgattacagttcctatgtaagacatgaaagaactcacactggagaaaaaccctataaatgtaaacgatgtggaagagccttcagtgtttccagttcccttcgaatacatgaaagaactcacactggagagaaaccctatgaatgcaagcaatgcgggaaagcatttcatcatctgggaagctttcaaagacacatgataaggcacactggagatggacctcataaatgtaagatatgtgggaaaggctttgattgtcctagttcactgcaaagtcatgaaagaactcacactggagagaaaccctatgaatgcaagcagtgtgggaaagcgttatctcatcactcaagctttcgaagtcatatgataatgcacactggagatggacctcacaaatgcaaggtatgtgggaaagccttcatttatcccagtgtatttcaaggacatgaaaggactcatactggtgagaaaccctatgaatgtaaagaatgtggtaaagccttccgtatttctagttcccttcgaagacatgaaacaactcacactggagagaaaccctataaatgtaaatgtgggaaagcctttattgatttctattcctttcaaaatcatgaaacaactcacactggagagaagccatatgagtgtaaggaatgtgggaaagcattcagttgtttcacatacctttctcaacatagaaggactcacatggctgaaaaaccttatgaatgtaaaacatgtaagaaagccttcagtcattttggtaacttaaaagtccatgaaaggattcacactggagagaagccatatgaatgtaaggaatgcaggaaagcattctcttggctcacttgccttctgcgacatgaaagaattcacactggaaagaaatcttatgaatgtcaacaatgtggtaaagccttcactcgttctcgtttccttcgaggacatgaaaaaactcacactggagagaagatgcatgaatgtaaggaatgtgggaaggcactgagttctctcagttccttgcatagacataaaaggactcactggagagatactctataaatgtggaaaagcattcattaattttatttcatttcagaaacgtgaaagaaatcacataggagataagcctcatgaatgcaaacacatggtaaagccttaagatgtttcttttgaatatggttatcccctaaccatatgcaggggattggttccagaccccctaagcatacctaaatccacagatgctgtgttccttttataaaaggacatttgcatgtaacctatccacatcctcctgcatcccataaatcatgcctagattacttaatttttcaccaacccaaagcttttgtaaaagtaaaaataaaaagtaggttactaaaatacctcatgtgttgtaaaagctatgtaaacagtcattttattgtattttttttagagaatcgtgatatgaaaataatcctgtgctgttgagaacagacccaaccatcacaggcctgcctacatagtacatgtcacctagaatgttacagtttctttttttcttttttttttttttaagacagagtttcactcttattgcccaggctggagggcaatggcacaatctcagctcactgcatcctctgcctcccgggttcaagcaattctcctgtcttagcctcctgagtagctgggattacagatgcatgccaccacacccagctaatttttttttttttttttttttttttgtatttttagtagagacggggtttcatcatattggtcaggctggtctcgaactcctgacctcagatgatctgcctgccttggtctcccaaagtgctgggattacaggcatgagcctgtaatctacagtttcttttttttcaacaatcatagattgcttttatttaatgacctggaatcgtgtgttaacacttatgaaaatcctgatccttcttgcttgataacccaaggatgatgatgatgatcatgatcatgatgatgctgattacagtatggtgcctaatatgattcactgaggtgactagatgggtggcactgtagataaacagtgagacatcaggctcacttgaatcttgacaggatgtcaggatgatcatctgtgttggatgaaccaggttctgattgcagatgctgagtttggaagagactaaataatactaatgtcagaatctgttcagcatgagggctgaagatgtgtacacactgaaggatctgtcttcatatttgcagatatttagttagaaacattgttgtaggaagctggttctttttctttaaatatccttgcagtgtttgttggcatgttatcccttgggtgacacagaggttttgttccattgaaggatcttacttgaggatggcaatctttattttatttttatttttatttatttatttatcatttgagactgagtttcgttcttattgcccagtctggagtgcagtggcgcgatctcgactcactgcaacctccacctcccagattcaagcgattctcctgcctcagcctccagagtagctgggattacaggcactcgccaccatgcctggctaatttttatttttagtagagatggggtttcaccatgttggtcaggctggtctcgaactcctgacctcaggtgatccacctgcctcggcctcccaaagtgctgagattacaggcatgagccaccgtgccctgcgaggattgtaatctttaatacttttcaccttgcagaggctgtagatgccccaaaaactgctgcacatgtttcaagtgtcacatctttgatattacctcttctaagtcttctgcatcatcattatcatcattatctgcagagaatttcagtatatcttcgagttccttgttagtatttatgctctcttatttgtgttgggatagaaagattaaggaaaggagagatgagaaggtggctcaacagttgagacagttttattgggagtaaacctgagaagggcttccagcggcagggtcaggtgcaaacttctcttacagcctgaggcttttttaaagggcccagtggagaagtgtgctttgaaacaaaattctgttagggaggggttggggaagtcctggctgttctgttacagttagggccgttattctctgttgaagttatgggcggggctgacattttcagttttggccaggtggccaaatagaaacttaaagcttaggatggtggagtgttataaagatggcggtgctcttgtcctgtcaatgtgttcctcaataaagtcttcaagcatgtcatagattgttttccccaccaacctcccttgcagcatttgagatattcctgatacttcatcaatagtggagaagctcctgaaatcattgacttcctcactccataatggtttccaacacccaatgaagtagtaggaggaaaacatgggtttcttctcctggaagcctccagaagaaggtatttcaatatggggagagtggtcagctgtgtcacaggtcactgagaatttgaataagacaaggaaaaagggttgactgtagattttggcaagtatttggtcactgggggccttgataagagctgtttcattgaagtattcatgagaataacttgtagtgaaatatatctcaaatagacctccacgatgttgcctagagggcagtgttaccctttgaactaccaacattaaccactggaactgctcatctggaagcctcttacagtgctggtacaaactagaatacacaaaggaagggatcattttatacgtgttactgtgctacttgctctatctacttagtgttccatacatgtaattacctattccatcctatcccaaagtactgaaaatctccattctactttctctgtctgtgaatttgactattcatagagagagagatatgtggaagtatgcatgtgtccttccatgtctggcttatttcacttagaacgttttcaaggtttatccatgtggtagcatgtatcaggaactcattgtttttgtgtctgaataaatttccactgtatggttaaagcatactttgtttatccatttttatgttgataaacatgggttgtttccacagtaataatttgactgctatcaataaggctgctgtggatgtggtatgtctatgtctgtgtgagtccctgctttcaattcttttggatatatgtatccctaggagtgtaattgctggttcacagaataattggtgtaaacctttttcaggaacaggtatattgctttacaaagtggctacaatgttttacattctctccagcaatgcataagggtttctattttccacattgtcacatatactggttgtcgtatttttttcataatagccaattaatggttctgtactgctttttcattgtggttttgatttgcatttccctaatgaccaataataatgcacattggtttttgtttttgttggttgtttatatattttttgaaccagtttgttttaaaatcctttgctcattaaaattgagtcatttgtgttttgttgttgagttataggaattcttatttaaaatttttagtttttaatatttagaaaatttctttcttttttcagctcccaagtgcttggaagagagttgtaggaattctttatacactgtgggtattaagcccttatttgatatgtgatatgcagatgtgttctccctttctgtaggttttcttttcatcttgagattgtcctttggtgcgcaaaagtttttaatttcgatgtagtccagtttatcttttattggttgtctgtgccttaaatgtcgtatccaataaatcactgccaaatttaa

SEQ ID NO: 202560 - DNA, 1906 bp, Homo sapiens
  Payload ID: 19945
  Gene Name: zinc finger protein 442
  Uniprot ID: Q9H7R0
  ENST ID: ENST00000438182
  CDS Start-End: 112-1788
agctgagagaagccctggcaggtcagtggcaggcactgtcacgctgagtcctatgctggcagcggggaaccttggggagaacacgggacaccgcggaagccgggaaatggaatgaaatgggaagacacaaacattgaagatcagcacagaaatcccaggaggagcctaagatgtcatatcatagagagatttagtgaaagtcgccagccagatagtactgtgaatgaaaaacctcctggagtagatccatgtaaaagcagtgtgtgtggagaaatcatgggttgttcattccttaattgctatatcacatttgatgctggacacaaaccagatgagtgtcaggaatatggagagaagccacatacacataaacaatgtgggacagccttcaattatcaccactcctttcaaacacaggaaagacctcacactggaaagaaacgctatgattgtaaggaatgtgggaaaaccttcagttcttcgggaaaccttcgaagacacataatagtacaacgtggaggtggaccttatatatgtaagttgtgtgggaaagcctttttttggcctagtttatttcgtatgcatgaaagaactcacactggagagaaaccgtatgaatgtaagcagtgttgtaaagccttccctatttacagttcctatctaagacatgaaagaacacacactggggagaaaccatatgaatgcaagcactgttccaaagccttccctgattacagttcctatgtaagacatgaaagaactcacactggagaaaaaccctataaatgtaaacgatgtggaagagccttcagtgtttccagttcccttcgaatacatgaaagaactcacactggagagaaaccctatgaatgcaagcaatgcgggaaagcatttcatcatctgggaagctttcaaagacacatgataaggcacactggagatggacctcataaatgtaagatatgtgggaaaggctttgattgtcctagttcactgcaaagtcatgaaagaactcacactggagagaaaccctatgaatgcaagcagtgtgggaaagcgttatctcatcactcaagctttcgaagtcatatgataatgcacactggagatggacctcacaaatgcaaggtatgtgggaaagccttcatttatcccagtgtatttcaaggacatgaaaggactcatactggtgagaaaccctatgaatgtaaagaatgtggtaaagccttccgtatttctagttcccttcgaagacatgaaacaactcacactggagagaaaccctataaatgtaaatgtgggaaagcctttattgatttctattcctttcaaaatcatgaaacaactcacactggagagaagccatatgagtgtaaggaatgtgggaaagcattcagttgtttcacatacctttctcaacatagaaggactcacatggctgaaaaaccttatgaatgtaaaacatgtaagaaagccttcagtcattttggtaacttaaaagtccatgaaaggattcacactggagagaagccatatgaatgtaaggaatgcaggaaagcattctcttggctcacttgccttctgcgacatgaaagaattcacactggaaagaaatcttatgaatgtcaacaatgtggtaaagccttcactcgttctcgtttccttcgaggacatgaaaaaactcacactggagagaagatgcatgaatgtaaggaatgtgggaaggcactgagttctctcagttccttgcatagacataaaaggactcactggagagatactctataaatgtggaaaagcattcattaattttatttcatttcagaaacgtgaaagaaatcacataggagataagcctcatgaatgcaaacacatggtaaagccttaagatgtttcttttgaatat

SEQ ID NO: 202561 - DNA, 567 bp, Homo sapiens
  Payload ID: 19945
  Gene Name: zinc finger protein 442
  ENST ID: ENST00000424168
  CDS Start-End: 106-567
aatgcaaatgtcccctgggaggggtcaggtcacagcgaagggaggaagcccaccctatcaagggctgtgtctggaaccgcttcatctcgctccactcagccgtgaatgaaatgggaagacacaaacattgaagatcagcacagaaatcccaggaggagcctaagatgtcatatcatagagagatttagtgaaagtcgccagccagatagtactgtgaatgaaaaacctcctggagtagatccatgtaaaagcagtgtgtgtggagaaatcatgggttgttcattccttaattgctatatcacatttgatgctggacacaaaccagatgagtgtcaggaatatggagagaagccacatacacataaacaatgtgggacagccttcaattatcaccactcctttcaaacacaggaaagacctcacactggaaagaaacgctatgattgtaaggaatgtgggaaaaccttcagttcttcgggaaaccttcgaagacacataatagtacaacgtggaggtggaccttatatatgtaagttgtgtgggaaagcctttttttggcctagttta

SEQ ID NO: 202562 - DNA, 1884 bp, Homo sapiens
  Payload ID: 19945
  Gene Name: zinc finger protein 442
  Uniprot ID: Q9H7R0
  ENST ID: ENST00000545749
  CDS Start-End: 1-1884
atgattgtatttgggggagaagacagaagtgatctcttccttcctgactctcagactaatgaagagagaaaacaatatgattcagtagcctttgaggatgtggcggtgaacttcacccaggaagagtgggctttgctgggtccatcacagaagagtctgtacagagatgtgatgtgggaaaccattaggaacctggactgtataggaatgaaatgggaagacacaaacattgaagatcagcacagaaatcccaggaggagcctaagatgtcatatcatagagagatttagtgaaagtcgccagccagatagtactgtgaatgaaaaacctcctggagtagatccatgtaaaagcagtgtgtgtggagaaatcatgggttgttcattccttaattgctatatcacatttgatgctggacacaaaccagatgagtgtcaggaatatggagagaagccacatacacataaacaatgtgggacagccttcaattatcaccactcctttcaaacacaggaaagacctcacactggaaagaaacgctatgattgtaaggaatgtgggaaaaccttcagttcttcgggaaaccttcgaagacacataatagtacaacgtggaggtggaccttatatatgtaagttgtgtgggaaagcctttttttggcctagtttatttcgtatgcatgaaagaactcacactggagagaaaccgtatgaatgtaagcagtgttgtaaagccttccctatttacagttcctatctaagacatgaaagaacacacactggggagaaaccatatgaatgcaagcactgttccaaagccttccctgattacagttcctatgtaagacatgaaagaactcacactggagaaaaaccctataaatgtaaacgatgtggaagagccttcagtgtttccagttcccttcgaatacatgaaagaactcacactggagagaaaccctatgaatgcaagcaatgcgggaaagcatttcatcatctgggaagctttcaaagacacatgataaggcacactggagatggacctcataaatgtaagatatgtgggaaaggctttgattgtcctagttcactgcaaagtcatgaaagaactcacactggagagaaaccctatgaatgcaagcagtgtgggaaagcgttatctcatcactcaagctttcgaagtcatatgataatgcacactggagatggacctcacaaatgcaaggtatgtgggaaagccttcatttatcccagtgtatttcaaggacatgaaaggactcatactggtgagaaaccctatgaatgtaaagaatgtggtaaagccttccgtatttctagttcccttcgaagacatgaaacaactcacactggagagaaaccctataaatgtaaatgtgggaaagcctttattgatttctattcctttcaaaatcatgaaacaactcacactggagagaagccatatgagtgtaaggaatgtgggaaagcattcagttgtttcacatacctttctcaacatagaaggactcacatggctgaaaaaccttatgaatgtaaaacatgtaagaaagccttcagtcattttggtaacttaaaagtccatgaaaggattcacactggagagaagccatatgaatgtaaggaatgcaggaaagcattctcttggctcacttgccttctgcgacatgaaagaattcacactggaaagaaatcttatgaatgtcaacaatgtggtaaagccttcactcgttctcgtttccttcgaggacatgaaaaaactcacactggagagaagatgcatgaatgtaaggaatgtgggaaggcactgagttctctcagttccttgcatagacataaaaggactcactggagagatactctataa

SEQ ID NO: 202563 - DNA, 2663 bp, Homo sapiens
  Payload ID: 19946
  Gene Name: zinc finger protein 443
  Uniprot ID: Q9Y2A4
  ENST ID: ENST00000301547
  CDS Start-End: 199-2214
aactgtcaatcaggcactgcccagagaagtgtgtgtggttgaaaaagcccgcggcgtctgctccacccacctgcgctcggctctgggttctgtagctgagagacgacctggaagttctgaggcagcctttgtctggctggaacacgcattggcagcgggagctgtcggtaggacctgggacaccgcggaagtcgggaaatggcctcagtggctttagaggatgtggctgtgaacttcacccgagaagagtgggctttgctgggtccttgtcagaagaatctctacaaagatgtgatgcaggaaaccatcaggaacctggattgtgtagtaatgaaatggaaagaccagaacattgaagatcaatatagatatcccaggaaaaatctaagatgtcgtatgttagagagatttgttgaaagtaaagatggaactcaatgtggagaaacatctagccagattcaagatagtattgtgaccaagaacactcttcctggagtaggtccttgtgaaagcagtatgagaggagaaaaagtcatgggtcattcatcccttaattgttacatcagagttggtgctgggcacaaaccacatgagtatcatgaatgtggagagaagccagatacgcataaacaacgtgggaaagccttcagttaccacaactcatttcaaacacatgagaggcttcacactggaaagaaaccatatgattgtaaagaatgtgggaagtccttcagttctttgggaaaccttcaaagacacatggcagtgcagcgtggagatggaccttataaatgtaagttgtgtgggaaagcgtttttttggcccagtttattacatatgcatgaaagaacgcacactggagagaaaccatatgaatgtaagcagtgttctaaagccttttctttttacagttcctatctaagacatgaaagaacacatactggggagaaaccgtatgaatgtaaacagtgttctaaagcctttcctttttacagttcctatctaagacatgaaagaacacatactggggagaaaccatataaatgtaagcagtgttctaaagccttccctgattccagttcttgtctaatacatgaaagaactcacactggagagaaaccctatacatgtaaacaatgtgggaaagccttcagtgtttccggttcccttcaaagacatgaaaccactcacagtgcagagaaaccctatgcatgtcagcaatgtgggaaagcgtttcatcatctgggaagctttcaaagacacatgataaggcacactggaaatggacctcataaatgtaagatatgtgggaaaggctttgattgtcctagttcactgcaaagtcatgaaagaactcacactggagagaaaccctatgaatgcaagcagtgtgggaaagcattatctcatcgctcaagctttcgaagtcatatgataatgcacactggagatggacctcataaatgcaaggtatgtgggaaagcctttgtttatcccagtgtatttcaaagacatgaaaggactcacactgcagagaaaccctataaatgtaaacaatgtggcaaagcctaccgtatttccagttcccttcgaaggcatgaaacaactcatactggagagaaaccctataaatgcaaacttgggaaagcctgtattgatttctgttcctttcaaaatcacaaaacaactcacactggagagaagccatatgagtgtaaggaatgtgggaaagcattcagtcgtttcagatacctttctcgacataaaaggactcacacaggagagaaaccttatgagtgtaaaacatgtaggaaagccttcggtcattatgataacttaaaggtacatgaaagaattcactctggagagaagccgtatgaatgtaaggaatgtgggaaagcattctcttggctcacttgctttctacgacatgaaagaattcacatgagagagaaatcctatgaatgtccacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccatatgaatgtaaggaatgtgggaaagcatttgcttctctcagttccttgcatagacataaaaagactcactagcattctctctaaatgtatggaatgtgggaaagcatttattaattttatttcatttcagatacttgtacgaaacacattggagatagaccctgtgaatgtaagcacttggtaaagccttaagtagtttcagtttctttccagtacagtcatcccttgatacctgctgggtattggttccagcactccgtgagccatgtccagtcccttttataaaatgacatgtttgtatgtaacttacccacatcctcttgtatagtctcaattatgtctagattacttaaaatacctcatgcattataaaagctatgcaaatagttgttctattgtattgtttagggaatcatgataaggaaaagagtctatgtattttcagtatagatgcagtaattgtgagcctatcaacatagtgtagtcagccagaacattaaagtttctttgtttcaactctc

SEQ ID NO: 202564 - DNA, 800 bp, Homo sapiens
  Payload ID: 19946
  Gene Name: zinc finger protein 443
  ENST ID: ENST00000436821
  CDS Start-End: 108-302
gtagctgagagacgacctggaagttctgaggcagcctttgtctggctggaacacgcattggcagcgggagctgtcggtaggacctgggacaccgcggaagtcgggaaatggcctcagtggctttagaggatgtggctgtgaacttcacccgagaagagtgggctttgctgggtccttgtcagaagaatctctacaaagatgtgatgcaggaaaccatcaggaacctggattgtgtagtaatgaaatggaaagaccagaacattgaagatcaatatagatatcccaggaaaaatctaaggtaatttacactcacaagagaaagatatgtccctggagccgttctgagaatgacatgaaaatttaaaaagaagcaaagaaaatgaacaagatgtcgtatgttagagagatttgttgaaagtaaagatggaactcaatgtggagaaacatctagccagattcaagatagtattgtgaccaagaacactcttcctggagtaggtccttgtgaaagcagtatgagaggagaaaaagtcatgggtcattcatcccttaattgttacatcagagttggtgctgggcacaaaccacatgagtatcatgaatgtggagagaagccagatacgcataaacaacgtgggaaagccttcagttaccacaactcatttcaaacacatgagaggcttcacactggaaagaaaccatatgattgtaaagaatgtgggaagtccttcagttctttgggaaaccttcaaagacacatggcagtgcagcgtggagatggaccttataaatgtaagttg

SEQ ID NO: 202565 - DNA, 2042 bp, Homo sapiens
  Payload ID: 19947
  Gene Name: zinc finger protein 444
  Uniprot ID: Q8N0Y2
  ENST ID: ENST00000337080
  CDS Start-End: 368-1351
cggggcttcatggggagttgttgggctgaacgagcggctcggagtatgggattgggggagggggacgggggagtttggcgcaaagcctgctggggcatggagtcccggcgagctttgtgcgcatgtgcggggaggtgagggggcttggggggcctcgcctgagagagtgaggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtgccgggactggctgcggcccgaggtgcacaccaaggagcagatgttggagctgctggtgctggaacagttcctgagcgcgctgcccgccgacacgcaggcctgggtgtgcagccggcagccgcagagcggggaggaggcggtggccctgctggaggagctctgggggccagcagcctcccccgatgggtcgtcagcaacgagggtgcctcaggatgtgacgcagggccctggggccacaggtggaaaggaggacagtgggatgattcccttagcaggcaccgcccctggggctgaggggccggcgcctggggactcccaggctgtgcgcccctacaagcaggagcccagcagccccccgctggcgcctggcctgcccgccttcctagcggccccgggcaccacgtcctgccccgagtgcggcaaaacgtccctgaaaccagctcacctgctgcgccaccggcagagccactcgggcgagaagccgcacgcctgccctgagtgcgggaaggcctttcggcgcaaggagcacctgcggcgccaccgcgacacgcaccccggcagccccggcagccccgggcccgcgctgcgccctctgcccgcccgtgagaagccccacgcgtgctgcgagtgtggcaagaccttctactggcgcgagcacctggtgcgccaccgcaagacgcactcgggagcgcggccctttgcctgctgggagtgtggcaagggcttcgggcgccgcgagcacgtgctgcgccaccagcgcatccacggccgggcagcggccagcgcgcagggggcggtagctccgggcccggatggtggaggccccttcccgccctggcccttgggttagccgcctcccggccagcgccatctcccgcccttggtgctgcccccgggcggtacctgctctctcccagcgccacttggcctcttcctctcctccttccctcccatcgtcctcctccacctgcgcctcccttgtctgaacttcccaacgccttcctattcctttccaactccttttcccccaaatttcactttccttctcaggtctcacctcagccccccccttctccctgatttctcggcctctctctctgtgtgaaggggcctctccctaatgtctcctccttcccccctcttctctctcctgcggcccagcctccctctccctcctccattcctctctccctgcccttttcctgcctgaagagcagaggtgaggacctgggacccctgaggggcaggccaggaggagctcgggcgcaggccaggcccccttggtgaagcagaggctgaaggaaaggggtctgggtcttgtccctaggaattctcctccctcaggagattgggggttgggggaggcagcgggtgatggctctgaagctgaacccagggcctggctgtggtcttcttggtcttgctgccccctgtgacccaaaggcatgggatggacagagatgcctgcccccgtgaagctggttggggagggcagttcaccagcatccatagagtaataaagtcactgtgtgtagacccgg

SEQ ID NO: 202566 - DNA, 562 bp, Homo sapiens
  Payload ID: 19947
  Gene Name: zinc finger protein 444
  ENST ID: ENST00000593100
  CDS Start-End: 265-562
aaagctgagtgggaagctggaccctacaaaggagtctgggggcgccgggaccggaccccttcggaaaggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtgccgggactggctgcggcccgaggtgcacaccaaggagcagatgttggagctgctggtgctggaacagttcctgagcgcgctgcccgccgacacgcaggcctgggtgtgcagccggcagccgcagagcggggaggaggcggtggccctgctggaggagctctggg

SEQ ID NO: 202567 - DNA, 646 bp, Homo sapiens
  Payload ID: 19947
  Gene Name: zinc finger protein 444
  ENST ID: ENST00000587467
  CDS Start-End: 377-646
gaaatgcagcttcaatctccaaccggagagatttctctccagagagtaaagggctggaagtgggggcgagacggaagccacagtatcaacctctgagaagccgcgttcattcctgccagacattgcgagatacagttgggaagaatttccaaggaattcttctctgccttggcagtgagggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtgccgggactggctgcggcccgaggtgcacaccaaggagcagatgttggagctgctggtgctggaacagttcctgagcgcgctgcccgccgacacgcaggcctgggtgtgcagccggcagccgcagagcggggaggag

SEQ ID NO: 202568 - DNA, 585 bp, Homo sapiens
  Payload ID: 19947
  Gene Name: zinc finger protein 444
  ENST ID: ENST00000588203
  CDS Start-End: 452-585
agcttgatggcctgtggcattgctctctggcggaaattcctccttagtcccagagggatcttttttatagcagagcaggcatctgtgtggcttttgagacttggatctggcctgggtcttccgataagtctttctgcctgctcccaggttcatcagcccttaaactgatggatgggtggggtgggaggtgatgctgtggcctggctgtggatgtgcaagtccaggctctgccacgtgttagctgagtgactttaggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtg

SEQ ID NO: 202569 - DNA, 642 bp, Homo sapiens
  Payload ID: 19947
  Gene Name: zinc finger protein 444
  ENST ID: ENST00000588358
  CDS Start-End: 426-642
gtgcattctgggaaatgtagtccaaagcctgtcgcgctcagacagcccgcgacatttgcgccgtcaaggccaaataggctgcagacgacgctttcgcgtatcttgggaaatgtagttccagtgttggcgaagacgccacgcggtgacaaacaggagtaaggcggtccccaggcgagggccaattggcagccgcctttgccgcgatgcttcctgggagttgtagttcggggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtgccgggactggctgcggcccgaggtgcacaccaaggagcagatgttggagctgctggtgctggaacagttcctgagcgcgctgc

SEQ ID NO: 202570 - DNA, 574 bp, Homo sapiens
  Payload ID: 19947
  Gene Name: zinc finger protein 444
  ENST ID: ENST00000586123
  CDS Start-End: 363-574
gtgcgcatgtgcggggaggtgagggggcttggggggcctcgcctgagagagtgagtcaacgaaatggagatacagggtattacaaaaggtgccttgtacctcgtccaaggacacagagctggtaggaggcagagctggaatttgccccagagcctttgtgccgtaggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtgccgggactggctgcggcccgaggtgcacaccaaggagcagatgttggagctgctggtgctggaacagttcctgagcgc

SEQ ID NO: 202571 - DNA, 1906 bp, Homo sapiens
  Payload ID: 19947
  Gene Name: zinc finger protein 444
  Uniprot ID: Q8N0Y2
  ENST ID: ENST00000592949
  CDS Start-End: 234-1214
gtgagggggcttggggggcctcgcctgagagagtgaggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtgccgggactggctgcggcccgaggtgcacaccaaggagcagatgttggagctgctggtgctggaacagttcctgagcgcgctgcccgccgacacgcaggcctgggtgtgcagccggcagccgcagagcggggaggaggcggtggccctgctggaggagctctgggggccagcagcctcccccgatgggtcgtcagcaacgagggtgcctcaggatgtgacgcagggccctggggccacaggtggaaaggaggacagtgggatgattcccttaggcaccgcccctggggctgaggggccggcgcctggggactcccaggctgtgcgcccctacaagcaggagcccagcagccccccgctggcgcctggcctgcccgccttcctagcggccccgggcaccacgtcctgccccgagtgcggcaaaacgtccctgaaaccagctcacctgctgcgccaccggcagagccactcgggcgagaagccgcacgcctgccctgagtgcgggaaggcctttcggcgcaaggagcacctgcggcgccaccgcgacacgcaccccggcagccccggcagccccgggcccgcgctgcgccctctgcccgcccgtgagaagccccacgcgtgctgcgagtgtggcaagaccttctactggcgcgagcacctggtgcgccaccgcaagacgcactcgggagcgcggccctttgcctgctgggagtgtggcaagggcttcgggcgccgcgagcacgtgctgcgccaccagcgcatccacggccgggcagcggccagcgcgcagggggcggtagctccgggcccggatggtggaggccccttcccgccctggcccttgggttagccgcctcccggccagcgccatctcccgcccttggtgctgcccccgggcggtacctgctctctcccagcgccacttggcctcttcctctcctccttccctcccatcgtcctcctccacctgcgcctcccttgtctgaacttcccaacgccttcctattcctttccaactccttttcccccaaatttcactttccttctcaggtctcacctcagccccccccttctccctgatttctcggcctctctctctgtgtgaaggggcctctccctaatgtctcctccttcccccctcttctctctcctgcggcccagcctccctctccctcctccattcctctctccctgcccttttcctgcctgaagagcagaggtgaggacctgggacccctgaggggcaggccaggaggagctcgggcgcaggccaggcccccttggtgaagcagaggctgaaggaaaggggtctgggtcttgtccctaggaattctcctccctcaggagattgggggttgggggaggcagcgggtgatggctctgaagctgaacccagggcctggctgtggtcttcttggtcttgctgccccctgtgacccaaaggcatgggatggacagagatgcctgcccccgtgaagctggttggggagggcagttcaccagcatccatagagtaataaagtcactgtgtgtagacccgga

SEQ ID NO: 202572 - DNA, 586 bp, Homo sapiens
  Payload ID: 19947
  Gene Name: zinc finger protein 444
  ENST ID: ENST00000591564
  CDS Start-End: 356-586
agcagttagttggggtggcttctgagtaggctgcaaagtgtctgctcccagggtgtggggtgcacggccccacaagtccagtgagggtggtgctgatggtgacctgctgctgccaggcctgctgcaagctctttctgtgttttctggttgaatcctcaggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtgccgggactggctgcggcccgaggtgcacaccaaggagcagatgttggagctgctggtgctggaacagttcctgagcgcgctgcccgccgacacgcag

SEQ ID NO: 202573 - DNA, 18299 bp, Homo sapiens
  Payload ID: 19948
  Gene Name: zinc finger protein 445
  Uniprot ID: P59923
  ENST ID: ENST00000396077
  CDS Start-End: 349-3444
ggagccgccgggaggtaggcgcgggacgggcggctgcggtggcggcgggtggaccgattgtcgctcggcggcgggagtcggtggagtctcgctctttcgcaaggctggagtgcaatggcatgatctcggctcactgcagcctccgcctcctgggttcaagtgattcttctgcctcagcctcccgagtagctgggactacagaaatgctggtaatttcagtcacttgctgatgacttctgatgtcccagcaaatgttggcattgttgactgctgagaagatacttctgaggacccacgtctaaggtggacttggttcgcactcttctggttagtccctgaacaggagtgatgcctccaggcaggtggcatgctgcctatccagctcaggcccagtcttcgagggagcgagggcggcttcagacagtaaagaaggaagaagaggatgaaagctatactccagtgcaggctgccaggccacagactctcaaccgccctggccaggagctgttccgccagctcttcagacagcttcgctaccatgagtcttcagggcccctagaaactctgagccggctccgggaactctgtcgctggtggctgaggcctgacgttctctccaaggcacagatcctagagctgctggtgctggaacagttcctgagcatcctgcctggggagctccgggtttgggtgcagcttcataaccctgagagtggcgaggaggctgtggccttgctggaggagctgcagagggaccttgatgggacatcctggagggacccgggccctgcccagagcccagatgtgcattggatgggtacaggagccctgcgatctgcacagatatggtcccttgcttcacctctcaggagcagctctgctctgggggaccacctggagcctccctatgaaatagaagcacgtgacttcctggctgggcaatccgatactcctgctgcccagatgcctgcccttttcccgagagaggggtgcccgggagaccaggtaacaccaaccaggtccctgacagcccagctccaggagaccatgactttcaaggatgtggaggtgaccttctcccaggacgagtgggggtggctggactctgctcagaggaacctgtacagggatgtgatgctggagaattataggaacatggcttccctggtgggaccattcaccaaacctgctctgatctcctggttggaagcaagggagccatggggcctgaacatgcaggcagctcagcctaaggggaatccagttgctgctcctacaggagatgacctccagagtaaaacaaacaaattcatcttaaatcaggaacctttggaagaagcagaaaccttagctgtgtcatcaggatgtcctgcgacaagtgtttctgagggaattgggctcagagaatcttttcaacagaagagcaggcagaaggatcaatgtgaaaatcccatacaagtaagagttaagaaagaagagaccaatttcagtcacaggacaggaaaagactctgaagtatcaggaagtaatagtcttgacttaaaacatgttacatatttgagagtttctggaagaaaggaatcccttaaacatggctgtggcaaacacttcagaatgagttcacaccactatgactacaagaaatatgggaaggggctcagacacatgattgggggcttcagcctacatcagagaattcatagtggactgaaagggaacaaaaaggacgtgtgtggaaaagacttcagccttagctctcatcaccaacgtgggcagagtcttcacacagtgggagtgtcatttaagtgcagtgactgtggaaggactttcagtcatagctcccatcttgcgtatcatcagagacttcacactcaagagaaagcatttaaatgtagggtgtgtgggaaagccttccggtggagttccaactgtgcgcggcatgagaaaattcacactggagtgaagccttataaatgcgatttatgtgagaaagctttccgacgcctgtcagcctaccgtctgcaccgagaaacccatgctaagaagaaatttcttgaattgaatcagtatagggcagctctcacctacagctcagggtttgatcatcatttgggagaccaaagtggggagaaactctttgactgcagccagtgcaggaaatccttccactgtaagtcatatgttcttgaacatcaaaggattcacacccaggagaagccctataaatgtaccaaatgtaggaaaacctttagatggagatcaaactttactcgtcatatgaggttgcatgaggaggaaaaattctacaaacaagatgaatgtcgtgaaggcttcaggcaatctcctgactgcagtcagccccagggtgctcccgctgtggagaaaacatttctgtgtcagcagtgtgggaaaacttttactagaaagaaaactctcgttgaccaccagagaattcacacaggtgagaaaccttaccagtgtagcgattgtgggaaggactttgcctataggtcagcctttattgttcataagaagaagcatgccatgaaaagaaaacctgagggcgggccatcttttagtcaggacacagtgttccaggttcctcagagcagtcactccaaagaggagccctacaaatgcagccagtgtggcaaggccttccgcaatcactcattcctcctcatccatcagagagttcacactggagagaagccatataagtgcagggagtgtgggaaagccttcagatggagttccaatctctaccgacatcagaggattcactctcttcaaaaacagtatgattgccatgaaagtgaaaagactccaaatgtggagccaaaaatcctcactggtgagaaacgtttttggtgtcaagaatgtgggaaaacctttacacgtaaaagaacccttttagatcataagggaatacacagtggagagaagcgctataaatgtaatctatgtgggaaatcttatgatagaaactatcgccttgttaaccatcagaggatccactctacagagagacctttcaaatgtcagtggtgtgggaaagagttcattgggagacataccctttccagtcaccagaggaaacacaccagagcagcacaggctgaacgtagcccgcctgcacggtcttcctctcaggacacaaagttgagattacagaagctaaaaccaagtgaagagatgcccctcgaagactgcaaagaagcttgcagccagagctccaggctcactggactccaggacataagcattgggaaaaagtgccacaaatgcagcatatgtgggaaaacttttaacaagagttcacaactcattagccacaagagatttcatactcgagagaggcccttcaaatgcagcaagtgtggaaagaccttcaggtggtcttcgaacctggctcggcatatgaaaaaccatattagagattagcctgggacctgacagtgacagtgggggtgggttctcagtcccctgctagagaacccttaattataggcattgtggagtaactttgataaagggcccagccctttctgttttggaagctagtgacagaatcccaaggatttgaaagctcggggagtccccagcctgcctgctaggatgtgacgctggggaagtgcagcaccatgtcctttggagcccttctggagactccggcccctaggagtggcctctgcaccatagcctgcggctcccctattcaggtctccttccacaactctgaagagagagaccactgccctttgtggttggacagaatatctgtggcatcatgggctatggctgctggaaaggggccagtgggatcctagatttgtcttcaagtttggcctgtggccatgcctattctgttgactttaaaagcagcagcatcaagaactcctagccttcccaaatgccccctggggagttctggctggggcttcagccttcctggctggcttttggatatctgctagggggttagagtggtctcagcggcaggtggaggagagcaggatgctgggctcaagcgcttggcgtgtggatctctaccagtaccctgttgccatccccatcccacaggcctgcataggcagcagcggtccatctgtttaacagaaatgtgctgagcactcccatacaccaggcgctggtgtgtttgccagagacccagcagggaccagaacagatgaaaatcctgccatcttggatctttacagatgacaaacaaatgggatacgcagtattctggatggtgatgtgtgtagtggacaaagtgaatcagagaagagcagagggagtgctggattgggagatcagtcgtgattttagatagtctggtcagggagggcctcaactgagaaggtgaaatgtgagcaaagacgtgaaggaagccagggaggtagcaggtagctctctagggagagttgcaggcagaggagattgggtcttgactggtgtcctcaggaaggaagcccctgggatggagtgcagggagccagctggaagggaaggagaggggccagggaggccacaggcccggccatatgagcatcatgggtcattacgggggcttgagctggctcagagggaggcagggagcttttggacaattttgagttgaggagtgatgtggtttgaatctgaattatattttataagggttaaccacagatccaaggactcagtaaaagggtgaaaggcttctcatgcagttagccttgctgccagttcccataaatcagactcctccccactccgtttctgaattttctataggatcctcggcctcagcagatataaacgcttaccattgttgtgttcatgtctctagcccctgcacactgcaggcccctctcagcttcacatacccctctccatgtatgagatctggtgctagcaatcagattcaacccgaaggaacaagtgcatgtgcctgctgctctcaggagaaaaggcagcctgttctgggaggagctccctcactggcccacccacttgtgttgaagcaaaaagcaagaatcaattacttaaaggcaaaggagtgatattgctaaagcatgtgagtaatcattgcttctgattattgaagaggtcagattatgaatgaaaggataaaatgttttaatagtagagcagtgtcctgactataggggcccgttcatggagctggtcatttcttgaaatgagaagaaaccaacctggaagatgtctttttcagtagagtatggaataatcttacctgctctggattgccatgagcaggtgaaaatgaaggctctgatattgtgtggtggtgtcacaggatggtgggggcggggcagaagtctcctgttggtgttctgatgcctgttcagctttgtcctcaggaaggtttggtcatcttggttctgccatcctcttgccttcctacggcagcagctgttcatggcactgaagatgtcccttcactgtcccaaaactggcactagaagtggctgggcaggggggccagagtcataggaagggtcttggagtcatcagatctgggttccaggcatggtgtgccttttcttggcaggattgatcttgagcaagtcaatgaacctctgcatcaatttccttatgtgtgaagttagagtgcttggctgtgctacctgattcctgagattggtgaaagagggcttggtttaccaaggctctccatcaggtggttgacctctaggaccagggccctctcagaggtgcagcttccatgtcagttggtgttgtaaccatggaaaagtccctttccaatcaaacttttagcacccctttccccccatctctgctccctttgccacaggataccttgtaaagttcctgccccagtatagggatatttttactgtcttttttattttttgagacagggttgcccagggtggagtgcagtggcaggatcacagcttactgcagccttgacctcccaggctcaggtcccatctgagcctcccgagtagctggggctacaggtgtgtgccaccctgccagctaattttttatatttttttgtagagacaaaacttttatttttttttcccatgttgctcatgctggtctcaaactcctgggctcaagcaatccacccacctctgcctcccaaagtgctgggattacaggcgtgagccactgtgcctgacctgtcatttttatagaatgaaatgtgcttatttctaaacattctaatcaaattttaaaatgtgcaaagaatgaagtgaaaaactgaatttttttttttttttgatacggagtctcactctgttacccaggctagagtgcagtggcgcgatctccgctcactgcaagctctgcctcctgggctcacaccattctcctgcctcagcctcctcagtagctgggactacaagtgcctgccaccacgcctgggttattttttatatttttagtagagacggggtttcactgtgttagccaggatggtctcgatctccaggatggtctcgatctccaggatggtctcgatctcctgacgtcgtgatccacccgcctcggcctcccaaaatgctgggattacaggtgtgagccactgtgcccggccaaaagaacagaaattattttatcctgaagtaagctgtttatatttgggattatactgaacctatttgtccaataacctgagttttcaaataattttagttctataagtactataattatataaatattaatgaattcagattagctgaaaggaaaaaaagtagaagcctgactacttggtgctaactactaaagattttggcagaatcaatgttggatttggctttcctgtcccttccccatgccagccccccagagtgttctgccttgtgctgcctcccttcacctggagtgccacacccctctctctgccagttcagctcttcattcttcaaggcctgaccttgtctgacccttgtgcctctaaacccgtggccccacctctcttggttcctatgtcaggtgatgtttgtgtttttggttatgcccatctccatagccagaccaagcactctggaagccagggttgggtgcttatttatctgtttgccatgcagaaaatatcttgcacaaaattacctctgttaaggaatctgaagctgaatttagtttggctgagtcagggttgggttttttttaaggggctgtggggtgaaatgttgactggaagccacccacaaacacacacctgctggttaggaacccggctgtgggtggttctgagctgtttggcttcagttgacagtttctgattgccctgagcaccaggtctcatcttgcatctcatcctggcctggagaacattcagtttccttccaacccttcccacctttcccccactcccttggaggaactgaagttggggttgaggagagccagatggctggagtgggtatttgaaggtctttctgtcacctgttcagtgtggtctgccccacccctgctgaccaagactgactgaaatgtaaaataatacagaccatctcacactcagaaagctggcacatttttgaaagcccaagtgtgggtaagtgcgtggaacaacgataattcacactgctttatgagtagaaattgtgagaaatattgtgccaggcaatttgcaaaatcttggaaggttgtgtgcacttaaccacccagcaactactcctggatgcatcctagagaagtgccatgtgaacagagaatgattttaagacttcactgaagtattgtttaggtagcaagattgggaaaagcctgcatttcatcagcagaagaatggataaataaatgggttgtttttggtccttggaaagtgaatatgaaagagttacgtctcaacacagatagatgaaaaattatgctgagaaagttggtgaagctacatacaaggtacccttagtgtaaagttaagcatactgtgtacctgtgggcacgttacttcaacttgtttttcactttttctgtaaaatgggatagtagtggcaatctcacagggtgattgtgggtgggggggtggtcaatgaagtaatgcatgtaaaatgcttagaatagtgtctagcatgtaagccttgtggacatatagaaagtgttattgttttgcacagtaatctattttctgtggattcaaataatatgaaatgagtataaaatcatgtattggaacgatgtgtgcaagtcaccattctgccttcctaaggcaggagacctgatggatttggggagggtacatggggccttcagttgtgttttctttgtttttttctaaaaattgatgcagaggcatcacaatgttaagatttttacagggtagtgtggtgggtactttttaactgtttgcttaaagtgtttcaaagtaaaaatatttcttaagcatagtctctgacatcttatgactttatagaaatccctgccaggtacatgatgttacttagagtgagccacctaatctttcaaggcttccatttcctcacctgcaaaaattgggagtgtcagaggcgtttgaaccagagtgactccatcttgaatagggaactgggtaaaataaggctgagacctactgggctgcattcccaggaggttaggcattccaagtcatgggatgagataggaggtcagcacaagatacagtcataaagaccttgccaataaaacagcatgtggtaaagaagccggtcaaaaccaagatggcaatgaaagtgacctctggttgtcctcactgctgtaattatactgtaattataatgcattagcatgctaacagacactcccaccagtgccatgacagtttacaaacgccatggcaggcctggcacgatggctcatgcctgtaatcccagcactttgggaggccaaggcgggcggattatgaggtcaggagattgagaccagcctggccaacatggtgaaaccctgtctctactaaaaaatacaaaaattagctgggcatggtggcacgtgcctgtaatcccagctacttgagaggctgaggcaggagaatctctagatcccgggagttggaggttgcagtgagccaagatggtgccactgcactccagcctgggtgacagagcaagactctgtctcaaaaaaaaaaaaaaaaaatgccatggcaacatcaggaagtaacactatatggtctaaaaaggagaggaaccctcagttctggtaattgctcacacctttcccgggaaacttatgaataatctaccccttgtttagcatataatcaataaataaccataaaaataggcaaccagcagcccttggggctactcttcctatggagtagccattctgtatttctttactttcttaatattaactactttcactttgtggactcgcccgaattcttttcttgagcaaggtccaagaactctctcttggggactggatcacgaccgctttctggtaacaggagcaatacaaatggctattagtaaacgaacgcttaagtaactctagtacatctatgatgaaataccaggccacagtttttttaaaaatgaggatgttctctatatactgacgcacagtcaccaagacatgcactttataggaaattataagctcctccttgcctaaatctccttaattttgcttaataaataacaagtgaagccagaagctgtaaactcataattttaatgaagaaatgggatccagaagatggagatgtttttcattctactttattagatgaggaaaaggagagtaaatacttgtatgccagctaccacaccttttaaagttaatgttaaccctgctaagaacagcaaggagattttatatcagccaggttttagttgccagaaaccacaccagttattttagcaaagaccttataaagaagtgtactatatttaagtagctaaaaaggcaagaagaaaatgccaaggtgtcttggaggtagcaactgctaagcagctgccaccccaggactgggggagctagaatagagtctccccatgtttgacgtttgtctgctaatagcattcaagctctccccctcagtttgcctggatctggacaagctgataagaaagcccagccacttcctctttgcgtcagaggggaagttcaaactgtgcaaaccctgactgtcaaatgcactgagctctcataaccacaacaaaaaccagagccacttgttcgtcctttcactgaagcccaacagactggcgtgggtgcccgctttgctttccctagaaggcctcatgtgagtagtaaactttttcataacctcttggtgtctgcagtgtcatcagtttcaacatccgaaccagttttgagtgatggtagtttattgatcccacctcatgtggagcaaagtgcaaagcaggaacaaagagacgtggctagaattgttgaaaggtgggagattggaagagggaccttgtggagctgaactcagacctatggtggaggagtggactgctgggctgacatagtgtctgtgctcagggaggggccctgtggcctttggatctgtgcttctgtggagaggtcccagctactaatgctggggcagggagcagaagggagggtcacaatgagactttgagtgttagttaaccaccttttgcctgaagaacatgtaatggccttccctgaggtatatgtcttccaaaagtccgctgacgttgctcatgacctatggtcaccactgctttttgcgttttgctttttttttttttttttttttgagacaaggtctcaccctgtcacccaggctggagtgcagtggcacgatctcagctcactgcaacctccactttcccaggctcaagcgattctccagcctcagcctcctgactagctgggactacaagcgtgcaccaccacacccagctaatttttgtatttttgtagagacaaggtttggccatgttgcccaagctggtcttgaactcctgacctcaagtgacccacctgcctcagcttgccaaagtgctgggattacaggtgtgagccaccatgcctggagtccttgttttttttttttttatacttttagggtacatgtgcacaatgtgcaggttagttacatatgtatacatgtgccatgctggtgcgctgcacccactaactcatcatctagcattaggtatatctcccaatgctatccctccccccctccccccaccccacaacagtccccagagtgtgatgttccccttcctgtgtccatgttttctcattgttcaattcccacctatgagtgagaatatgcggtgtttggttttttgttcttgcgatagtttactgagaatgattatttccaccttcatccatgtccctacaaaggacatgaactcatcattttttatggctgcatagtattccatggtgtatgtgtgccacattttcttaatccagtctatcattgcctggagtccttttaaaaaaattatttttttggccaggcacggtggctcacacctgtaatcccagcactttgggaggctgaggcgggcagatcacgaggtcaagagatcgagaccatgctggctaacgcggtgaaaccccgtctctagtaaaaatacaaaaaattaaccgggcgtggcagcgggcgcctgtagtcccagctactcgggaggctgaggcgggcagatcacgagatcaggagattgagaccagccagcctggccaatatggtgaaaccccatctctattaaaaatacaaaaattagccgggtgtggtggtgtgtgcctgtaatcctagctactggggaggctgaggcaggagaatcacttgaacccaggaggtggaagttgcagtgagccgagatcgcacaactgcactccagcctgggcgacagagtgaaactttgtctcaattaaaaaaaaaaaaaagtgaagtgcaaaatgtgactgaggagatacagtactctccaaattgcataattttgccaatttttatagaaacctggggaatctgtagagatagcgtcagaagcattggaacgagagcaactccatgttgaataggggctgggtaaaagtgtcagaggtatttgaaccagagcgactccattttgagtgagggctgggaaaatgaggctgagacttactggcctgcattctcagaaagttaggcattcctaccctctaggattgaattgggacccctttcctgtaacatatttctggtgaccacagaagggactatagtgcagaaacgttgacccaacggctacctttgcgtaagtgttggggtcctgtaacatatttctggcaaaccacagaaaggatgatactgaagaaatccccccaaccccaaagaaatagactgcagcactgattggacgactttgggtaagtgatggggtacccgagtaacaaatgggattgggttagaggcccaacttaggggagttggagtttctcctaagacagagtgagttagaggcccctcttaataaaaggcaaggacacttgactgacctcaggttagaggttactccatcctactctatggagtagctgtcctttcaccactttactttcttaataaacttgtttttgctttgcactgcggacttgccctgaatcctttcttgcacgagatccaagaactctcttaagagtctggatcgggacccctttcctgtaacaaaatgaggctgagacctactgggctgcattcccagacggttaaggcattctaagtcacgggatgagataggagattggcacaagatccaggccacaaagaccttgctgataaagcaggttgcagtaaagaagccagctaaaacccaccaaaaccaagacggtgatgagaatgacctctggtcatcctcactgctaccctcccaccagtgccatgacagtttacagttgccatggcaacatcaggaagttaccctatatggcctggagaggggaggcatgaataatccaccccttgtttagcatatcatcaagaaaccataaaatagacaaccagcagccctcggggctgctctgtctatggagtagccattcttttattcctttacttaataaacttgctttctctttacggactcgccctgaattctttcttgtgcgagatccaagaaccctctcttggggtctggattgggaaccttttgcggtaacaagggtgcaggatcatcgtggaaggaatataaagtcagatcaagctgaattattcgatatgggataattaagcagagatttgtggttcattgttttaacttgagaagctgagaatggctgtcttcatttgctttgagttgttgagatatggactcactgtaatcccagcttgggaggctgaggtgggaggattgcttgaggccaggagtttgagactggcttgggcaatatagtgagaactcatctccaaaagaaaaaaaaaacacgaatgcaaacataacctgcactgaatgagttgaaatgcgagaacttcgttggtatactgtagaggaagatatgtaaatgcttaaggagataaaaatgcttgagtatttatcatgtaaatacctgctcacccacccagggagggtccagaggacacttcattatgagaaataaattcatgtagagagtgccagatattctatacaggccacattacagtgggaaatgctccctgaagtgcagtggggctgatggaatcctgaggaggcagggaccatatggtaacacttagtcaccaaaaacacaattggtgtggtgactgccatggacagtgcagccaaagcaggatcctgaatggtctgacccacagagatctgtgatgtctgcctgctgatcatagtgtcctgagaactgaaatggatgggctgcctactaaagttttacttgatccgagtaagtaggaaagctccagatctggtgaataaagtctgacctaaattaccaacacagagttacaatcactcagtcaattccaagtcttgatctagttcacaaacccacagcttcttgaataaaggataggccaggtccctttgaagtaggaccctgctgcactgacaataatttatactttttatcttcctaggcctccccaaaggcacccaaggccatttatcagagtgattgtgcattgggaagggcaaataattagacttttctgggataaccagcctctagttctgaactagcagtaattacaggagactcaaaatgccaccatggttcctcagagtaagagtgtatggaggtcaggtgatcaatgggctttttggctcagattcatctcacagtagatctagtagattcctgaacccatcctatggttatttccctggttctagaatgcgtaattagaatagacatagtcaacaatgggcagaatcccacactagttccctgatccatacagtaaaagtaattctggtagaaaaggccaagtagaagccactagagctgcctcattcacaaaaatattaaagcaaactaataccacattcctggagagattgttgagattagtgccaccatcaaagacgggaacacatctccacttagctcacctactcagcctgtgcagaagacagatggatcttggagaatgacaattggattaattgtaaacttaattaactagtgattccaagtgcaggtgctgtttccacatgtggtttcagtgctgagcaaacgatacgtctgacaactggtttgcagttgttactgagccaggcccaggtttgttctgttctcacacagtaaatcaatcactgtgacatgggttttgcaaaagagagaagaattattcacaaggctgtccagtgaggagatgggagaatggctctcaaattcacctccccaaagatgaggcttagagagatttataggttagagaagtagggtggtctgaggcatggggaaaggtgattggcagtggggaaaaatgcagtcataattggggttcatatgacatatgtgcagaaaatggtggcgttaacatgatctgagggtggagtttttggccctctgatgtcaaaaggccacctcttgggcatgtgtacaggcccagttgaagggttggcagtctcaactggtttgaactggacaggatctgccccaagttcctgaaaaataagtggttgttatggtgacttataaatgttatctataaggtagcacgtaaaagttgagttacagtgttcaatagcatagccttcagctatcgtggccttcagcttcatgggggaaaaaataacaaagagcaagcaaccaaaagcaagcggggcaggcgaagtgtggcacacccgatccgattatccccttggctgcccagttacccatctggtgaatgtttctctatacctgtgagtaaagaccatcaggaacagtttgctttcagctagatacaccttcaccaccctatctcaaggctgcctcaactctgccgcccagctcatgatctagttcccaggtcctttgagaaccttttcaccctcaggacgacacactggtccattatattgatgacattatagtcactggacctggtgtacagggagtagcaactgctccagacatgttggaagacacataatatgactcagtgtaggaaataaacccacaacatggctaagggcaaataatgtttccaaaacttctttctctcttttttttttcttttttgagacagagtctcactctgtagctcgagctggagtggaggcaatcttggctcactgcaacctgcacctcctgggtacaagtgaagctgcttcctcagcctgttgggactacaggtgtgcgccaccacgcccggctaatttttttttttttttttttggtaaaggcagggtttcaccatgttagccagcttggtcttgaactcttgacctcaagtgatctgcccacctcagcctcccaaagtgctgggattacagaagtgagccaccaagccaggccctttttctctctctttccaatagttacattctatatgtttaaaagggacacgagacaattttgtatgtgattttctgaatcacataattccacatttaacattttggggaaatgccaaactgttttccaaaggggctgcctgggagtctcagctctagttctcagtcctcagcagccattcctttcctcagtggggcgtcagtgctgccttccaaagtccagggctgccttgagacctgatcaggaccggctattttgccaggtgcagtgcatgatgttcaagaccattcagaatttcaagaccctgacagcagagcaagatagcaggcggaggccattctaagtgtggggccccgcagggctgcccaggctgcctgcctgtgaagccagtcctgcctgatggagatgcttttgccatggcgtgagggaaagtgagctgatggttctccactttcccactctctctctgcaggtccggctcctctaagggcagaagccagaacttggtccctgaaccttctccagtctccctccctgggcatttctctcataaccccatcagaccccccagtaatggcctgacgtgggttctggaaatagaacatgggttcttagaatggctctctgagacttcattgagttgtctgtcctatttctttcctcaacaaaatgtccacatcctcaatctcctgtctcagcaggaaagatgaaaagaacagtgaggcttaggccaggcacggtggctcacacctgtaatcccaacactttgggaggctgaggtgggcagatcacctgagaacgggagttcgagaccagtctgaactccctgtctctactaaaaatacaaaagtagccaggcgtggtagcgggcacctgtaaatcccagctactggggaggctgagacaggagaatcgtttgaacctgggaggcggacgttgtggtgagccgagatagtgccactgcactccagcctggacaacagagcgggaaaaaaaaaaaaaaagaacgatgacccttagcatcccaggaagctttgggtggtgagagatggagagtatctccttcctgtggtacttcagtttcccgtctccttgttaggatgttgcaaagctggcctgctgaggtcttctgtgatctcctgtgcttcctacacttccacctgaaaatgaacctactgcagggatgaatccatgagcagaattttaatgaaaaggaagcagacacaaaggaatccatgggttgtaactccaccgacttaaaatgaaaaacacaggcaacaaagaacaggcacgatgctgcttcgccagctggttccttgttgggttctgccattcagggatgtaagagggaagctgggatgttggaggactggagtgtgagggtaaattttaggtgtcaacttggctgagccacaaggtccccaggtatttgatcaaacattatgctgggtgtttctgtgaggttgctttggatgagattaacgtttaaatttgtggactttgaggaaagcagattgccctctatctgtgggtgggcttcatccaatcacctgaagacctgaggagaacataaagtctggctgccccagactctctctcaggcaagagagaattcttccgcagactgccttcagagttcatgcacaccatctactaatcctgctccacagcaggtgccactgggctctcactggaatatgtattctcctggttctccagcctgctcatccaccctgaagatttgggacttgccagcctccttaattctataagccaattccttatcataaattcataaatccctctctctctatctccatccacacacacacacacacacacacacacacacacacagacacacacacacaaatgagtgtagatgtgttccaataaaacttcatttagagacattgaaatttaaatttcaagggctgggcatggtggctcaacgcctgtaatctcagcactttgggaggctgaggcaggtggatcacttgaggtcaggagttcgagaccagcctggccaacatggtgaaaccccgtctctactaaaaatacaaaacatgtagccacgtgcagtggctcatgcctgtaatcccagctgggaggctaagatgggagaatagcttgaacacaggaggcagaggttgctgtgagctgaaatggtgcccagaagacagagcgaccctgtctcaaaaaaataaaaaataaaaaataaatttcatataatcttcagatatattcattcatttacatattgtctgtggttgttttcaccctttaggtcagaagtagccgacaacctttacacagtatttaccactgttatagacatctttaaatatggtttacttttgcctgtttttgtactttatagaaatgaagtaataaagtattgtctgtcttgc

SEQ ID NO: 202574 - DNA, 10052 bp, Homo sapiens
  Payload ID: 19948
  Gene Name: zinc finger protein 445
  Uniprot ID: P59923
  ENST ID: ENST00000425708
  CDS Start-End: 152-3247
acagaaatgctggtaatttcagtcacttgctgatgacttctgatgtcccagcaaatgttggcattgttgactgctgagaagatacttctgaggacccacgtctaaggtggacttggttcgcactcttctggttagtccctgaacaggagtgatgcctccaggcaggtggcatgctgcctatccagctcaggcccagtcttcgagggagcgagggcggcttcagacagtaaagaaggaagaagaggatgaaagctatactccagtgcaggctgccaggccacagactctcaaccgccctggccaggagctgttccgccagctcttcagacagcttcgctaccatgagtcttcagggcccctagaaactctgagccggctccgggaactctgtcgctggtggctgaggcctgacgttctctccaaggcacagatcctagagctgctggtgctggaacagttcctgagcatcctgcctggggagctccgggtttgggtgcagcttcataaccctgagagtggcgaggaggctgtggccttgctggaggagctgcagagggaccttgatgggacatcctggagggacccgggccctgcccagagcccagatgtgcattggatgggtacaggagccctgcgatctgcacagatatggtcccttgcttcacctctcaggagcagctctgctctgggggaccacctggagcctccctatgaaatagaagcacgtgacttcctggctgggcaatccgatactcctgctgcccagatgcctgcccttttcccgagagaggggtgcccgggagaccaggtaacaccaaccaggtccctgacagcccagctccaggagaccatgactttcaaggatgtggaggtgaccttctcccaggacgagtgggggtggctggactctgctcagaggaacctgtacagggatgtgatgctggagaattataggaacatggcttccctggtgggaccattcaccaaacctgctctgatctcctggttggaagcaagggagccatggggcctgaacatgcaggcagctcagcctaaggggaatccagttgctgctcctacaggagatgacctccagagtaaaacaaacaaattcatcttaaatcaggaacctttggaagaagcagaaaccttagctgtgtcatcaggatgtcctgcgacaagtgtttctgagggaattgggctcagagaatcttttcaacagaagagcaggcagaaggatcaatgtgaaaatcccatacaagtaagagttaagaaagaagagaccaatttcagtcacaggacaggaaaagactctgaagtatcaggaagtaatagtcttgacttaaaacatgttacatatttgagagtttctggaagaaaggaatcccttaaacatggctgtggcaaacacttcagaatgagttcacaccactatgactacaagaaatatgggaaggggctcagacacatgattgggggcttcagcctacatcagagaattcatagtggactgaaagggaacaaaaaggacgtgtgtggaaaagacttcagccttagctctcatcaccaacgtgggcagagtcttcacacagtgggagtgtcatttaagtgcagtgactgtggaaggactttcagtcatagctcccatcttgcgtatcatcagagacttcacactcaagagaaagcatttaaatgtagggtgtgtgggaaagccttccggtggagttccaactgtgcgcggcatgagaaaattcacactggagtgaagccttataaatgcgatttatgtgagaaagctttccgacgcctgtcagcctaccgtctgcaccgagaaacccatgctaagaagaaatttcttgaattgaatcagtatagggcagctctcacctacagctcagggtttgatcatcatttgggagaccaaagtggggagaaactctttgactgcagccagtgcaggaaatccttccactgtaagtcatatgttcttgaacatcaaaggattcacacccaggagaagccctataaatgtaccaaatgtaggaaaacctttagatggagatcaaactttactcgtcatatgaggttgcatgaggaggaaaaattctacaaacaagatgaatgtcgtgaaggcttcaggcaatctcctgactgcagtcagccccagggtgctcccgctgtggagaaaacatttctgtgtcagcagtgtgggaaaacttttactagaaagaaaactctcgttgaccaccagagaattcacacaggtgagaaaccttaccagtgtagcgattgtgggaaggactttgcctataggtcagcctttattgttcataagaagaagcatgccatgaaaagaaaacctgagggcgggccatcttttagtcaggacacagtgttccaggttcctcagagcagtcactccaaagaggagccctacaaatgcagccagtgtggcaaggccttccgcaatcactcattcctcctcatccatcagagagttcacactggagagaagccatataagtgcagggagtgtgggaaagccttcagatggagttccaatctctaccgacatcagaggattcactctcttcaaaaacagtatgattgccatgaaagtgaaaagactccaaatgtggagccaaaaatcctcactggtgagaaacgtttttggtgtcaagaatgtgggaaaacctttacacgtaaaagaacccttttagatcataagggaatacacagtggagagaagcgctataaatgtaatctatgtgggaaatcttatgatagaaactatcgccttgttaaccatcagaggatccactctacagagagacctttcaaatgtcagtggtgtgggaaagagttcattgggagacataccctttccagtcaccagaggaaacacaccagagcagcacaggctgaacgtagcccgcctgcacggtcttcctctcaggacacaaagttgagattacagaagctaaaaccaagtgaagagatgcccctcgaagactgcaaagaagcttgcagccagagctccaggctcactggactccaggacataagcattgggaaaaagtgccacaaatgcagcatatgtgggaaaacttttaacaagagttcacaactcattagccacaagagatttcatactcgagagaggcccttcaaatgcagcaagtgtggaaagaccttcaggtggtcttcgaacctggctcggcatatgaaaaaccatattagagattagcctgggacctgacagtgacagtgggggtgggttctcagtcccctgctagagaacccttaattataggcattgtggagtaactttgataaagggcccagccctttctgttttggaagctagtgacagaatcccaaggatttgaaagctcggggagtccccagcctgcctgctaggatgtgacgctggggaagtgcagcaccatgtcctttggagcccttctggagactccggcccctaggagtggcctctgcaccatagcctgcggctcccctattcaggtctccttccacaactctgaagagagagaccactgccctttgtggttggacagaatatctgtggcatcatgggctatggctgctggaaaggggccagtgggatcctagatttgtcttcaagtttggcctgtggccatgcctattctgttgactttaaaagcagcagcatcaagaactcctagccttcccaaatgccccctggggagttctggctggggcttcagccttcctggctggcttttggatatctgctagggggttagagtggtctcagcggcaggtggaggagagcaggatgctgggctcaagcgcttggcgtgtggatctctaccagtaccctgttgccatccccatcccacaggcctgcataggcagcagcggtccatctgtttaacagaaatgtgctgagcactcccatacaccaggcgctggtgtgtttgccagagacccagcagggaccagaacagatgaaaatcctgccatcttggatctttacagatgacaaacaaatgggatacgcagtattctggatggtgatgtgtgtagtggacaaagtgaatcagagaagagcagagggagtgctggattgggagatcagtcgtgattttagatagtctggtcagggagggcctcaactgagaaggtgaaatgtgagcaaagacgtgaaggaagccagggaggtagcaggtagctctctagggagagttgcaggcagaggagattgggtcttgactggtgtcctcaggaaggaagcccctgggatggagtgcagggagccagctggaagggaaggagaggggccagggaggccacaggcccggccatatgagcatcatgggtcattacgggggcttgagctggctcagagggaggcagggagcttttggacaattttgagttgaggagtgatgtggtttgaatctgaattatattttataagggttaaccacagatccaaggactcagtaaaagggtgaaaggcttctcatgcagttagccttgctgccagttcccataaatcagactcctccccactccgtttctgaattttctataggatcctcggcctcagcagatataaacgcttaccattgttgtgttcatgtctctagcccctgcacactgcaggcccctctcagcttcacatacccctctccatgtatgagatctggtgctagcaatcagattcaacccgaaggaacaagtgcatgtgcctgctgctctcaggagaaaaggcagcctgttctgggaggagctccctcactggcccacccacttgtgttgaagcaaaaagcaagaatcaattacttaaaggcaaaggagtgatattgctaaagcatgtgagtaatcattgcttctgattattgaagaggtcagattatgaatgaaaggataaaatgttttaatagtagagcagtgtcctgactataggggcccgttcatggagctggtcatttcttgaaatgagaagaaaccaacctggaagatgtctttttcagtagagtatggaataatcttacctgctctggattgccatgagcaggtgaaaatgaaggctctgatattgtgtggtggtgtcacaggatggtgggggcggggcagaagtctcctgttggtgttctgatgcctgttcagctttgtcctcaggaaggtttggtcatcttggttctgccatcctcttgccttcctacggcagcagctgttcatggcactgaagatgtcccttcactgtcccaaaactggcactagaagtggctgggcaggggggccagagtcataggaagggtcttggagtcatcagatctgggttccaggcatggtgtgccttttcttggcaggattgatcttgagcaagtcaatgaacctctgcatcaatttccttatgtgtgaagttagagtgcttggctgtgctacctgattcctgagattggtgaaagagggcttggtttaccaaggctctccatcaggtggttgacctctaggaccagggccctctcagaggtgcagcttccatgtcagttggtgttgtaaccatggaaaagtccctttccaatcaaacttttagcacccctttccccccatctctgctccctttgccacaggataccttgtaaagttcctgccccagtatagggatatttttactgtcttttttattttttgagacagggttgcccagggtggagtgcagtggcaggatcacagcttactgcagccttgacctcccaggctcaggtcccatctgagcctcccgagtagctggggctacaggtgtgtgccaccctgccagctaattttttatatttttttgtagagacaaaacttttatttttttttcccatgttgctcatgctggtctcaaactcctgggctcaagcaatccacccacctctgcctcccaaagtgctgggattacaggcgtgagccactgtgcctgacctgtcatttttatagaatgaaatgtgcttatttctaaacattctaatcaaattttaaaatgtgcaaagaatgaagtgaaaaactgaatttttttttttttttgatacggagtctcactctgttacccaggctagagtgcagtggcgcgatctccgctcactgcaagctctgcctcctgggctcacaccattctcctgcctcagcctcctcagtagctgggactacaagtgcctgccaccacgcctgggttattttttatatttttagtagagacggggtttcactgtgttagccaggatggtctcgatctccaggatggtctcgatctccaggatggtctcgatctcctgacgtcgtgatccacccgcctcggcctcccaaaatgctgggattacaggtgtgagccactgtgcccggccaaaagaacagaaattattttatcctgaagtaagctgtttatatttgggattatactgaacctatttgtccaataacctgagttttcaaataattttagttctataagtactataattatataaatattaatgaattcagattagctgaaaggaaaaaaagtagaagcctgactacttggtgctaactactaaagattttggcagaatcaatgttggatttggctttcctgtcccttccccatgccagccccccagagtgttctgccttgtgctgcctcccttcacctggagtgccacacccctctctctgccagttcagctcttcattcttcaaggcctgaccttgtctgacccttgtgcctctaaacccgtggccccacctctcttggttcctatgtcaggtgatgtttgtgtttttggttatgcccatctccatagccagaccaagcactctggaagccagggttgggtgcttatttatctgtttgccatgcagaaaatatcttgcacaaaattacctctgttaaggaatctgaagctgaatttagtttggctgagtcagggttgggttttttttaaggggctgtggggtgaaatgttgactggaagccacccacaaacacacacctgctggttaggaacccggctgtgggtggttctgagctgtttggcttcagttgacagtttctgattgccctgagcaccaggtctcatcttgcatctcatcctggcctggagaacattcagtttccttccaacccttcccacctttcccccactcccttggaggaactgaagttggggttgaggagagccagatggctggagtgggtatttgaaggtctttctgtcacctgttcagtgtggtctgccccacccctgctgaccaagactgactgaaatgtaaaataatacagaccatctcacactcagaaagctggcacatttttgaaagcccaagtgtgggtaagtgcgtggaacaacgataattcacactgctttatgagtagaaattgtgagaaatattgtgccaggcaatttgcaaaatcttggaaggttgtgtgcacttaaccacccagcaactactcctggatgcatcctagagaagtgccatgtgaacagagaatgattttaagacttcactgaagtattgtttaggtagcaagattgggaaaagcctgcatttcatcagcagaagaatggataaataaatgggttgtttttggtccttggaaagtgaatatgaaagagttacgtctcaacacagatagatgaaaaattatgctgagaaagttggtgaagctacatacaaggtacccttagtgtaaagttaagcatactgtgtacctgtgggcacgttacttcaacttgtttttcactttttctgtaaaatgggatagtagtggcaatctcacagggtgattgtgggtgggggggtggtcaatgaagtaatgcatgtaaaatgcttagaatagtgtctagcatgtaagccttgtggacatatagaaagtgttattgttttgcacagtaatctattttctgtggattcaaataatatgaaatgagtataaaatcatgtattggaacgatgtgtgcaagtcaccattctgccttcctaaggcaggagacctgatggatttggggagggtacatggggccttcagttgtgttttctttgtttttttctaaaaattgatgcagaggcatcacaatgttaagatttttacagggtagtgtggtgggtactttttaactgtttgcttaaagtgtttcaaagtaaaaatatttcttaagcatagtctctgacatcttatgactttatagaaatccctgccaggtacatgatgttacttagagtgagccacctaatctttcaaggcttccatttcctcacctgcaaaaattgggagtgtcagaggcgtttgaaccagagtgactccatcttgaatagggaactgggtaaaataaggctgagacctactgggctgcattcccaggaggttaggcattccaagtcatgggatgagataggaggtcagcacaagatacagtcataaagaccttgccaataaaacagcatgtggtaaagaagccggtcaaaaccaagatggcaatgaaagtgacctctggttgtcctcactgctgtaattatactgtaattataatgcattagcatgctaacagacactcccaccagtgccatgacagtttacaaacgccatggcaggcctggcacgatggctcatgcctgtaatcccagcactttgggaggccaaggcgggcggattatgaggtcaggagattgagaccagcctggccaacatggtgaaaccctgtctctactaaaaaatacaaaaattagctgggcatggtggcacgtgcctgtaatcccagctacttgagaggctgaggcaggagaatctctagatcccgggagttggaggttgcagtgagccaagatggtgccactgcactccagcctgggtgacagagcaagactctgtctcaaaaaaaaaaaaaaaaaatgccatggcaacatcaggaagtaacactatatggtctaaaaaggagaggaaccctcagttctggtaattgctcacacctttcccgggaaacttatgaataatctaccccttgtttagcatataatcaataaataaccataaaaataggcaaccagcagcccttggggctactcttcctatggagtagccattctgtatttctttactttcttaatattaactactttcactttgtggactcgcccgaattcttttcttgagcaaggtccaagaactctctcttggggactggatcacgaccgctttctggtaacaggagcaatacaaatggctattagtaaacgaacgcttaagtaactctagtacatctatgatgaaataccaggccacagtttttttaaaaatgaggatgttctctatatactgacgcacagtcaccaagacatgcactttataggaaattataagctcctccttgcctaaatctccttaattttgcttaataaataacaagtgaagccagaagctgtaaactcataattttaatgaagaaatgggatccagaagatggagatgtttttcattctactttattagatgaggaaaaggagagtaaatacttgtatgccagctaccacaccttttaaagttaatgttaaccctgctaagaacagcaaggagattttatatcagccaggttttagttgccagaaaccacaccagttattttagcaaagaccttataaagaagtgtactatatttaagtagctaaaaaggcaagaagaaaatgccaaggtgtcttggaggtagcaactgctaagcagctgccaccccaggactgggggagctagaatagagtctccccatgtttgacgtttgtctgctaatagcattcaagctctccccctcagtttgcctggatctggacaagctgataagaaagcccagccacttcctctttgcgtcagaggggaagttcaaactgtgcaaaccctgactgtcaaatgcactgagctctcataaccacaacaaaaaccagagccacttgttcgtcctttcactgaagcccaacagactggcgtgggtgcccgctttgctttccctagaaggcctcatgtgagtagtaaactttttcataacctc

SEQ ID NO: 202575 - DNA, 1291 bp, Homo sapiens
  Payload ID: 19948
  Gene Name: zinc finger protein 445
  ENST ID: ENST00000617032
  CDS Start-End: 152-973
acagaaatgctggtaatttcagtcacttgctgatgacttctgatgtcccagcaaatgttggcattgttgactgctgagaagatacttctgaggacccacgtctaaggtggacttggttcgcactcttctggttagtccctgaacaggagtgatgcctccaggcaggtggcatgctgccatcagctcaggcccagtcttcgagggagcgagggcgcttcagacagtaaagaaggaagaagaggatgaaagctatactccagtgcaggctgccaggccacagactctcaaccgccctggccaggagctgttccgccagctcttcagacagcttcgctaccatgagtcttcagggcccctagaaactctgagccggctccgggaactctgtcgctggtggctgaggcctgacgttctctccaaggcacagatcctagagctgctggtgctggaacagttcctgagcatcctgcctggggagctccgggtttgggtgcagcttcataaccctgagagtggcgaggagctgtggccttgctggaggagctgcagagggaccttgatgggacatcctggagggacccgggccctgccagagcccagatgtgcattggatgggtacaggagcctgcgatctgcacagatatggtcccttgcttcacctctcaggagcagctctgctctgggggaccacctggagcctccctatgaaatagaagcacgtgacttcctggctgggcaatccgatactcctgctgcccagatgcctgcccttttcccgagagaggggtgcccgggagaccaggtaacaccaaccaggtccctgacagcccagctccaggagaccatgactttcaaggatgtggaggtgaccttctcccaggacgagtgggggtggctggactctgctcagaggaacctgtacagggatgtgatgctggagaattataggaacatggcttccctgggtaagtaatcgatatcctcatgcttctatccatctttatttctgccttcttgggttgttctgtgctgcatagaaaggtacctgacctggttttagatcctggctctgtaactgctgaccagatcacttaatctagcaccttggtagcctcttttgaaaaatggggagaataatgcctgccattctggattattgtaaagattaaaggtggctgggtgtggtagctcacacctgtaatcccaccacttcgggaggcccaggtgggaagattgcttgagctcaggagtttgagaccagtctgggcaacatagtgaaaccccatctcta

SEQ ID NO: 202576 - DNA, 1291 bp, Homo sapiens; identical to SEQ ID NO: 202575
  Payload ID: 19948
  Gene Name: zinc finger protein 445
  ENST ID: ENST00000635138
  CDS Start-End: 152-973

SEQ ID NO: 202577 - DNA, 10052 bp, Homo sapiens; identical to SEQ ID NO: 202574
  Payload ID: 19948
  Gene Name: zinc finger protein 445
  ENST ID: ENST00000634579
  CDS Start-End: 152-3247

SEQ ID NO: 202578 - DNA, 18299 bp, Homo sapiens; identical to SEQ ID NO: 202573
  Payload ID: 19948
  Gene Name: zinc finger protein 445
  ENST ID: ENST00000635479
  CDS Start-End: 349-3444

SEQ ID NO: 202579 - DNA, 1889 bp, Homo sapiens
  Payload ID: 19949
  Gene Name: zinc finger protein 446
  ENST ID: ENST00000335841
  CDS Start-End: 118-1128
ttttggggacagatcccgaagttcgagcatccctcggataggccgggtgtcaggcctggtctctcaggcccgtccaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtggcaccctccagccctccacttgcagcacagtcccctgaggggaaccatggacaccaagaaccagcctccacatccttccacccacccaggattcagggttaccgccccaccagccagaggcacaggcccagtcagagctggggatgctgctcacggggacaggcgtctgcagaagcctgcgctcgggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccacacaggccagcggcgtcacttctgcagtgactgtggccgcgccttcgactggaagtcgcagctggtcatccaccgcaagggccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttcataata

SEQ ID NO: 202580 - DNA, 569 bp, Homo sapiens
  Payload ID: 19949
  Gene Name: zinc finger protein 446
  ENST ID: ENST00000600013
  CDS Start-End: 147-569
acatccgggaagcggcctccaagcaaccgctccgggttgagatcccgaagttcgagcatccctcggataggccgggtgtcaggcctggtctctcaggcccgtccaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttgggagcccccacccctca

SEQ ID NO: 202581 - DNA, 3922 bp, Homo sapiens
  Payload ID: 19949
  Gene Name: zinc finger protein 446
  ENST ID: ENST00000596341
  CDS Start-End: 2221-3420
tccaaaatcctgcagctatcctgccctatacacaaagagcccagatccaggccccacacacttgatattggggccagactcttccacctgtgaaacctcacaggttcctgcagggagtggagacacacagaacctagctcccctggagcctgcaagacttgggccaccagaatcccagtaggtccctgaaccattgtcccccagtaagtctgcagagctgtgaaatgcagacaataacccttccctgcctgaaagagcacttttctggggagcccatgggagtcaggagcaaaagcatctgtcaaacaagtagatacccagagagtcacgtgaaatcatttctatgcctctgacagacgcttcttgagcgaagtttctgccctgagcccgcctgaccccttaggctgggctcagtaccctaccttgtcttcccaccagccgcctccctccatcaagttcctttccacgtctgcttgtgcccctgttgtccctcagtttgtccaccctcctccaatcttcccctccccaaacccatgactgatcagtggcccccaacctaggctcccacctccatgcaggtcttggcccctcggctgacctccctccaacctccccctctgctcttaattttgaataggtagtgactgtaaaagtatccctgggcttctatgtcaaaaggtcagactgaacacatgcatctcactgggctcagaaatccactgaaaccacagaggggagtatttaaaacacataacccacaagtatgaggatggtgacagaggagtcaggagcaatggcattcctaagctagaagtgggtgagagctgtcactaagttagggaaggcaaaatactacgtggcgacttggcgaagaggagagagttcccaccaggctgactccagaaccgcagaaggctgagaaccagcagcccagagacgggagacctatatcaaagctgcctggggaacaactactgaagaagcccttaacgccccagtgctctccccacatggtggagggtgaaagtttttgtttttttttccttctgggactctgcatagtcccagagaaaaggcctaagcacctcatccccaaaaacaacctgaggaggccgttggaaagctccgagttgacaagtctcatccacgcacatgctcggtgcttccaatcggtgatcaagaccactgctcttcatccagagcaggcagcagggattcccaggtatccaaagaaaccaaaacaggcggtgtaatttaggactgactaagtaatggctcggccacttttaagtgtggaagcaaaactgaccccacagatttagaaaactgtaacactgcttattgggagaaactagtgtcaccctggctagttctgctccccaaattcaaaggtaaataaacggttgagcatgtccgatcagcctggagggaaacctccacccccgactttgtaggactgacatctgaagacgtcagagactgcggtcacaaccgtcggtacctccttagggcgcttaacagaggtcaaagatggccctcgcaccctcctggcgggagaaagcccaggctcagggtggtcttctacaccaccgcctctcccgggtccacttggaagcgagtcccagcgaactactcgacctaggaaaccactgggccgccacttccagcctcttcggaagtcgaggcaacgctcctgaacgttgccacgggaacagctggaggcgggcggatatgccctagcgttatctaggggctggcccggggaatggcgtgggggcggcggggccaagcaagcgccacctctgattgggcaaaaccccctcccctcacctgccaatagaaaccggcccactgtacagacgcgcaagtttataacccgggaagagctgctctcagagcggagggagaccatataaccctgggactctgccgtacctcctagaggaacagagcgcctctcaggcgtcagaggctgctgcaaatgcgggtcagcgggtcacggtcgcgcctgtcttgctgatgctcatgggaaatgtagttcaaagggcatgggcggtgccttcggtgcaggcgagagattggtcagcgcggcgtcgccggggcaacacccggctgaggcgccccgcgttgtgcggcgccacatccgggaagcggcctccaagcaaccgctccgggttgaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtggcaccctccagccctccacttgcagcacagtcccctgaggggaaccatggacaccaagaaccagcctccacatccttccacccacccaggattcaggaggagtgggggctgctggaccggtcacagaaggaactgtactgggatgcgatgctggagaagtacggcacagtggtctccctggggttaccgccccaccagccagaggcacaggcccagtcagagctggggatgctgctcacggggacaggcgtctgcagaagcctgcgctcggagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccacacaggccagcggcgtcacttctgcagtgactgtggccgcgccttcgactggaagtcgcagctggtcatccaccgcaagggccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttcataa

SEQ ID NO: 202582 - DNA, 2238 bp, Homo sapiens
  Payload ID: 19949
  Gene Name: zinc finger protein 446
  Uniprot ID: Q9NWS9
  ENST ID: ENST00000594369
  CDS Start-End: 382-1734
gaagcggcctccaagcaaccgctccgggttgaggtgagcgcaggctgccagagtgggcgcagcctttccaccccgtgggagggcttggggtcgccctctggggcctgaacggctcctgctgtcggcgccctggagggcccgcccacttcccgacaggccgcgcgcgtcacctcagccttcgctcaggcctttcctaccctcaacgccgttccggggggccgggcctggcaagtcctcttggaacgcctccctcttgccttccccttttggggacagatcccgaagttcgagcatccctcggataggccgggtgtcaggcctggtctctcaggcccgtccaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtggcaccctccagccctccacttgcagcacagtcccctgaggggaaccatggacaccaagaaccagcctccacatccttccacccacccaggattcaggaggagtgggggctgctggaccggtcacagaaggaactgtactgggatgcgatgctggagaagtacggcacagtggtctccctggggttaccgccccaccagccagaggcacaggcccagtcagagctggggatgctgctcacggggacaggcgtctgcagaagcctgcgctcgggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccacacaggccagcggcgtcacttctgcagtgactgtggccgcgccttcgactggaagtcgcagctggtcatccaccgcaagggccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttcataata

SEQ ID NO: 202583 - DNA, 1869 bp, Homo sapiens
  Payload ID: 19949
  Gene Name: zinc finger protein 446
  ENST ID: ENST00000610298
  CDS Start-End: 103-1371
ccgaagttcgagcatccctcggataggccgggtgtcaggcctggtctctcaggcccgtccaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtggcaccctccagccctccacttgcagcacagtcccctgaggggaaccatggacaccaagaaccagcctccacatccttccacccacccaggattcaggaggagtgggggctgctggaccggtcacagaaggaactgtactgggatgcgatgctggagaagtacggcacagtggtctccctggggttaccgccccaccagccagaggcacaggcccagtcagagctggggatgctgctcacggggacaggcgtctgcagaagcctgcgctcgggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttc

SEQ ID NO: 202584 - DNA, 1884 bp, Homo sapiens
  Payload ID: 19949
  Gene Name: zinc finger protein 446
  ENST ID: ENST00000622313
  CDS Start-End: 118-1386
ttttggggacagatcccgaagttcgagcatccctcggataggccgggtgtcaggcctggtctctcaggcccgtccaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtggcaccctccagccctccacttgcagcacagtcccctgaggggaaccatggacaccaagaaccagcctccacatccttccacccacccaggattcaggggttaccgccccaccagccagaggcacaggcccagtcagagctggggatgctgctcacggggacaggcgtctgcagaagcctgcgctcgggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccacacaggccagcggcgtcacttctgcagtgactgtggccgcgccttcgactggaagtcgcagctggtcatccaccgcaagggccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttc

SEQ ID NO: 202585 - DNA, 3773 bp, Homo sapiens
  Payload ID: 19950
  Gene Name: zinc finger protein 449
  Uniprot ID: Q6P9G9
  ENST ID: ENST00000339249
  CDS Start-End: 141-1697
agttgccggtgagcttgggagaaccgtgggcgctgaggcgctgtaggtggctccctcccaccccaacgatttcagagagaaacaagtcggaatctgagaagtgaggctccagataaactgtaaactgctggaagggggcgatggctgtggccctgggttgtgcaatccaggcatccttgaatcaaggctctgtgtttcaagaatatgatactgactgtgaagttttccgtcagcgcttcaggcagttccagtacagagaagcagctgggcctcatgaagcatttaacaaactctgggagctttgctgtcaatggctgaagccaaagatgcgctctaaggaacaaatcctggagctgctagtgttggagcaattcctaactatcctgcccacagagatagagacctgggtgagggagcactgcccagagaatagagaaagagttgtgtcactgatagaagacttacagagagaacttgagataccagagcagcaggttgatatgcatgacatgctcttggaagaactggcaccagtgggaacggcacacataccaccaaccatgcacctagagtcacctgcactccaggtaatgggacctgcccaggaggccccagtagcagaggcatggatcccacaggcagggccaccggagctgaactatggtgctactggagaatgtcagaactttctggaccctggatatccattaccaaaacttgacatgaacttctcattggagaatagagaagagccatgggtgaaggaattacaggattctaaagaaatgaaacaattacttgattccaagataggttttgagatcgggatagaaaatgaagaagatacttcaaaacagaaaaaaatggagactatgtatccatttattgtaactttagaggggaatgctctccagggtcccattttgcaaaaagactatgtacagttagaaaatcaatgggaaacccccccagaggatttacagacagatttagcaaaactggtagatcagcagaaccccactctgggagagacacctgagaactccaacttggaagaacctctcaaccctaaaccccacaagaaaaagagtccaggagagaaacctcaccgatgtcctcagtgtggaaaatgttttgctcggaagtcacaacttactgggcatcagagaattcattcaggagaagaacctcacaaatgccctgaatgtgggaaaagattccttcgtagttcagacctttatagacaccaacgacttcatacaggggagagaccctatgaatgcactgtatgtaaaaagcgattcactcggcggtcacatcttatagggcaccagagaacccattctgaagaagaaacatataaatgtcttgagtgtgggaaaagtttttgtcatggatcaagtcttaaaagacatctgaaaactcatacaggtgaaaaacctcatagatgtcataattgtgggaaaagttttagtcgactgacagctcttactttgcaccagagaacgcatactgaagagagaccttttaaatgtaattattgtgggaaaagttttagacagagaccaagcctcgttattcatttaagaatccacacaggggagaagccatacaagtgtactcattgttctaaaagcttcagacagagagccggccttattatgcaccaggtcactcactttagaggacttatttaagaattgctaagggaaacaggtcttacacaaattgacactaactcaaaaaaaatcttaacctgcagcaggctgtttgtcttggaagcttttgtttgagcttataagaacatagacagcttttttttttactagttttaaaacccatcttccaaggtatatgaattctagagtatttatctactcctgtgattttcttagatttgatttcttctgtctgcacaactcttctttttttaattacaatgaaaaattttgtgttccaaggcaactgtatcataggtgtaaacataaagcatataaattatgacaatccttttagaggtagggtcaatatagtggataaacctgtctatcagacgtattgattatagcagtactatagttattctgctgtcattattaaagatgattatattcattcaaagctttagatgtgtcccatgtggcaagaaaggagacagtgaattttgtcaaacaataaaaatgtgtcaggaacacaaggatgaaggggatgtcatttgcctggtaagaactgggttatttccactgaaatttgttatgtttaaggaaattaagattttaagcttgaaattatacaagcagaatctaatttaattttgattgactgaagaaccagggtcttttgctctcctttggtatttcactctcctttggtattcaatcatgtgtcttttagtgctttttaaaattttacccattctttaattcagcatctccctatgtatgtgtcatagaatacttagttctgctagatattctgcaaatatatttgggaattacttcctgctgtttcgccttcttaggttcatagtacacatcagcatatgagaatctctgagaggtcctctagaaaggagagaaaaagcacctcttttggctcaatgttttccaaacttatttgaccccaaaacctttttcatatacccaataataagctacagaactaatattctgcaaatgtctcttggaacacactgccttaaacagatatttctatagctgtcagtatagttatgttgctcccaagcctagttatctccagttgttttaagggtgttatgaaaaattcttaaaatatatatgaatttgtgtaacacacacagagacacacacacatactactttaagggggtgaggatcattaattcagataatttttaagtttcctagtgattctcaatctctttgaattttacttacatttacacacacacgcacacacatatgtatatacacatatcattttaagaagctgaggatcactaattcagataatgtataagtttcccagtgattctcaacctctttgaattttacttataattacatacacacacacactgctacttatataaatgttctcatgtaatcatggtaacagctcaaattcccaaagcaagggaagacttctcattgtcagttaaacctgttaaaacatgaaaatattcattgagcctagttccttgttataaaatacaagaaataagacattcaggcattttccctttatgaagatgttcagtcatcctttccttgaactacaattaggaaaagtatatgtctttattccattgaagttctcgagagtgatataaatactttggggggtatctactatgtgcctaactagtcctgttctaggcttagtggaagctagtaaagaaatataattcatggatcaggctcataaagattttataatatttttagttaaacaagagttgggaaacaggtggagaataatgcaagagagtttgtaattaagtgccaattataccaattgctagacccaggatgtatctttaattcttgtcatccaggtcaacatatgatgctgctataagtctggggctcaaattgatatcccagtagcaataaacatataatataggaggagtctgaatgtagagatgaaaaatacagaatgtaatggcttctcttttctctcttgtggaattgcattcaaaccagaacagtgccttagaatggatgtgcccaactgctctgtatttatgcaatatttgaataaagcggaaatgtatgtgctcttcctgc

SEQ ID NO: 202586 - DNA, 2051 bp, Homo sapiens
  Payload ID: 19950
  Gene Name: zinc finger protein 449
  Uniprot ID: Q6P9G9
  ENST ID: ENST00000370761
  CDS Start-End: 141-635
agttgccggtgagcttgggagaaccgtgggcgctgaggcgctgtaggtggctccctcccaccccaacgatttcagagagaaacaagtcggaatctgagaagtgaggctccagataaactgtaaactgctggaagggggcgatggctgtggccctgggttgtgcaatccaggcatccttgaatcaaggctctgtgtttcaagaatatgatactgactgtgaagttttccgtcagcgcttcaggcagttccagtacagagaagcagctgggcctcatgaagcatttaacaaactctgggagctttgctgtcaatggctgaagccaaagatgcgctctaaggaacaaatcctggagctgctagtgttggagcaattcctaactatcctgcccacagagatagagacctgggtgagggagcactgcccagagaatagagaaagagttgtgtcactgatagaagacttacagagagaacttgagataccagagcagcaggtaagaaaagaatgtgggatctttgtgattggtccaaaggaagtagctgaggcagctgggactagaccacacatttgtctctatgtcattccccagcctcaagatttctccagagtcctcttcctttttctcttctgctgaactcagcaaatgagtcagtgcttttaactctatcagactcaattccccttctataacaaatagtttataatgtccactttactatgcacaaatgaaattgatagacaacataatctacccacatacatcaacccaaagcatcagtaaattgctccatggcctgaaggccaattctagccataccctgtttatctgtatactctgtatgtaatggtttttttatcttgttgaaaggtcattgaaaaaaagaggaaggagaagaactgacagtgaatgtgccccacagtgcctaaaatatttactatttggctctttataaagtttgccaaccctgaatcaagtctagaaggaatataaaggaaaagaaacatagtttgttataaattgatagggatttgtacatatatgtgcttgggcctgaccgaatgtcatgaagttgtcagatgtttgcatctatgcttagaatcattgtgaatgggacagccagaaattcagactgataaagctcaagtactacgaacagtgttgctcctcgtcatgtgattttccaaaatggcatacgactctaggtaaatctgaacaataagcagtgtagtctttgcttttcacattagtgcattcctagaaaatttcatttgtgctgaaactatgcaaaacaaaacaaacaattgtacttatttgaccaacaaggtggggttcttgacaggttctttttactcacatgaatgtttgagtgggacattccacacttggtagggacctagaacaattctgcattgtaaattatgttccattaaattctgatagccaccacctgtcagcatatccaaaactccccatggggacagtggcactgtctgccattcagaatgactgtgtaaagcctcttttcagaagtgccgtgactgagagagggcagtatctttgggaaaagggagcaggagcttccagatgggcatcagggatactccagtcttgtctatgggggttctctgcaggagctgttagcttcagggctcctgaacaggagtcttctgaagttttctgtctccctagggtacttgggttggtggttgcccttcctttctctgtctccttggttttgtttactatataagattttatcttcatgtggtctagacatttgctgctgaatacagtcactactagtcatgtacagctcttgagcccttgaaatatggccaatacaaattgagatctgctgtaagtatgaaatacacaccacatgcagaagacttggtatgaaaaaagtaggtgaaatatctcactaataattgttcatattgattacatgttgaaatcctgattgtttgcactggattaagtaacacgtactattaagattggccttactttttaaaaaatttattcatatggccactagaaaatttaaaa

SEQ ID NO: 202587 - DNA, 3898 bp, Homo sapiens
  Payload ID: 19951
  Gene Name: zinc finger protein 45
  Uniprot ID: Q02386
  ENST ID: ENST00000269973
  CDS Start-End: 1092-3140
gagagcgcggccttcattcctctcgtggaagtgagtgagtcctgggaccccgcgacctgttttaacttttatggtttggtcgtaggatcagcagggctcgcacttcggtcagcaggaaaagacgctgcggcgagcagcggagggcggagttgaatggctgggcagctgattgccttactgtatccggagctgctgcgttcggggcggttcgggagtcccctggttggaagtggacctgaatggggaggcgtctgaggatctcctgggctctcagcggcccgacccgccttcccccacctcccacagctctgtagcttcctagcggtgtaacgttgggaaaggaggctgttcttggactatgcctgacccgttttttaagaaagagtgcatcactcaacaggtggcgtctggagttatcctctgtggattttccaggatctcagacaagatcgtgcaatctcccagcctcctttccttcccctgccctgacttctgaaagaatgctgcgggagaggaggaaggagagcatcctggcttctggcagcagagccccactgtgacaggacctagcattcaccttcctcttctgttccgagtgcgagaagacttcagggacctctgtttcatggacattatcatattcttctcaagagtacccagcaagaggtttgcaaagaggagttattcagtgaaatcagaatcataccctgagagctacaagaactccatttttcactgtgcagaggctctctgctgaagggtcaagtggaatctggaatccagcccatgtttccccatcatcaagccatgtgaagctgcagactccaagcaacagagagacaagatttagaatactggctctggtatgaaagctggattcaggtactgttcctgcctcttgacctcaccaagcctcagcttcctcgcctgttaaatggatacaattgtcgtcattatcatctgttgagaactccctaaaatgccagctgagcataggcacagaagtttaggtgtttggaccaaggtcacacaactgatacaacagtagcttcttcacagacttggcacttctccagaaggaggaggacaaaatgacgaagtctaaggaggcagtgacattcaaggacgtggctgtggtcttctctgaggaggagctgcaactgctggaccttgcccagaggaagctgtaccgagatgtgatgctggagaacttcaggaatgtggtctcagtggggcatcagtccacaccagatggcctaccacagttagagagagaagaaaagctgtggatgatgaagatggcaacccagagagataactcctcaggagccaagaatctaaaagagatggagactcttcaagaagtaggattaaggtacctgcctcatgaagagcttttctgctcccagatctggcaacagattacaagagagttaatcaagtatcaagattctgtggtaaatattcaaagaacaggctgccagttggaaaaacgagatgatttgcactataaagatgagggattcagtaatcagagttcccatcttcaagttcacagagtccacactggtgaaaaaccctacaaaggagaacattgtgtgaaaagtttcagctggagctctcatcttcaaattaaccaaagggctcatgcaggagagaagccctacaaatgtgaaaaatgtgataatgccttccgtcggttttcaagtcttcaagcccatcagagagtccacagtagagcaaaatcatacacaaatgatgcaagttacaggagttttagtcagaggtcacatcttccccatcatcagagagttcccactggagagaatccatacaaatatgaagagtgtgggaggaatgttgggaaaagctcacattgtcaagctcctctgatagttcatacgggagagaaaccctataaatgtgaggagtgtggggtgggcttcagtcagagatcatatcttcaagttcatctgaaagttcacactggaaagaaaccatataagtgtgaagagtgtgggaagagcttcagttggcgttcacgactgcaggctcatgagcgaatccacactggcgagaaaccatacaaatgcaatgcatgtggcaagagctttagttacagctcacaccttaatattcattgtagaatccacacaggagagaaaccctataagtgtgaggagtgtgggaaaggtttcagtgtgggttcacaccttcaggcccatcagataagccacactggagagaagccatacaaatgtgaggagtgtgggaaaggcttctgccgggcctcaaatctgctggaccatcaaagaggccatactggagagaaaccgtatcagtgtgatgcatgtggtaagggcttcagtcgtagctcagattttaacattcattttagagtccatacaggggaaaaaccctataaatgtgaggagtgtggcaagggcttcagccaggcctcaaatcttctggcccatcaaagaggccacactggagagaaaccctacaaatgtggtacatgtgggaagggcttcagtcggagctcagatcttaatgtacactgtagaatccacacaggagagaaaccctataaatgcgagaggtgtggtaaggccttcagtcagttctccagccttcaggtgcatcagagagttcacactggagagaaaccatatcagtgtgcagagtgtgggaagggcttcagtgtaggttcacagcttcaagcccatcagaggtgccacactggagagaaaccctatcaatgtgaggagtgtgggaagggcttctgtcgggcctccaattttctggcacatcgtggagtccacacaggagaaaaaccataccgatgtgatgtgtgtggtaagcgcttcagacagagatcctaccttcaagcccaccagagggtccacacaggagagagaccatacaaatgtgaggaatgtgggaaagtcttcagctggagctcataccttcaagcccatcaaagagttcacaccggagaaaaaccatacaaatgtgaggagtgtgggaagggcttcagttggagctcaagtcttatcattcatcagcgagtccatgctgatgatgagggtgacaaggactttccttcatcagaggattcacacaggaaaactcgataaaatatgttttactatctcagatgggtgctgaaatattttaataatcagagctatcatagacaaaacatttgttttatagagtcagtagttcagccaagtgattgggagaccacacagcagagaagcctcacaagagtggagacatatggactgcattcagaacattgaccattagctgatacatgcagacaagaggatcaggaaggatgagtctgatctggagtaaatcagaagtactaagatagaaatgctgaattctgttccactagaatataagatccaagagggcagggactttgttgactgccaaatctactctgccttttcagtgcctaatacgttgtaatttttcagtagtatttgaaattactgtcatatttgaaattcagtaatatttgacatttttatttatctctagaagtttctctaaaattgtactcagaagaattctgcaaggcttggaggatatataagttagtcatatggcctgattttcccatttttgcagatctcgtggacaagtgtttatcaaactgaaggttgcagcttgttagtgggttcagaaatcagtttctggctagcaactagaagttttgtatgttaacagtactttattgaggtgtaatctgcatgcagtaacatgcacaagtctcaagttcatggctttctgaattttgacaaatgtaatcatcaccaagatcaatgtatacaatatgtctattaaaccaaaaagttttcttgtgcccatttccagtcaa

SEQ ID NO: 202588 - DNA, 520 bp, Homo sapiens
  Payload ID: 19951
  Gene Name: zinc finger protein 45
  ENST ID: ENST00000588140
  CDS Start-End: 134-520
tttattgcaagatttaggtggagtgtgtttgatgttgtaggaggcagtgacattcaaggacgtggctgtggtcttctctgaggaggagctgcaactgctggaccttgcccagaggaagctgtaccgagatgtgatgctggagaacttcaggaatgtggtctcagtggggcatcagtccacaccagatggcctaccacagttagagagagaagaaaagctgtggatgatgaagatggcaacccagagagataactcctcaggagccaagaatctaaaagagatggagactcttcaagaagtaggattaaggtacctgcctcatgaagagcttttctgctcccagatctggcaacagattacaagagagttaatcaagtatcaagattctgtggtaaatattcaaagaacaggctgccagttggaaaaacgagatgatttgcactataaagatgagggattcagtaatcagagttcccatcttcaagttcacagagtccacactggtgaaaaaccctacaaa

SEQ ID NO: 202589 - DNA, 2409 bp, Homo sapiens
  Payload ID: 19951
  Gene Name: zinc finger protein 45
  Uniprot ID: Q02386
  ENST ID: ENST00000589703
  CDS Start-End: 103-2151
tggttttttttttggccaaactctcatggcttttttctccttccctcatgttttctccttccctcttaagacttggcacttctccagaaggaggaggacaaaatgacgaagtctaaggaggcagtgacattcaaggacgtggctgtggtcttctctgaggaggagctgcaactgctggaccttgcccagaggaagctgtaccgagatgtgatgctggagaacttcaggaatgtggtctcagtggggcatcagtccacaccagatggcctaccacagttagagagagaagaaaagctgtggatgatgaagatggcaacccagagagataactcctcaggagccaagaatctaaaagagatggagactcttcaagaagtaggattaaggtacctgcctcatgaagagcttttctgctcccagatctggcaacagattacaagagagttaatcaagtatcaagattctgtggtaaatattcaaagaacaggctgccagttggaaaaacgagatgatttgcactataaagatgagggattcagtaatcagagttcccatcttcaagttcacagagtccacactggtgaaaaaccctacaaaggagaacattgtgtgaaaagtttcagctggagctctcatcttcaaattaaccaaagggctcatgcaggagagaagccctacaaatgtgaaaaatgtgataatgccttccgtcggttttcaagtcttcaagcccatcagagagtccacagtagagcaaaatcatacacaaatgatgcaagttacaggagttttagtcagaggtcacatcttccccatcatcagagagttcccactggagagaatccatacaaatatgaagagtgtgggaggaatgttgggaaaagctcacattgtcaagctcctctgatagttcatacgggagagaaaccctataaatgtgaggagtgtggggtgggcttcagtcagagatcatatcttcaagttcatctgaaagttcacactggaaagaaaccatataagtgtgaagagtgtgggaagagcttcagttggcgttcacgactgcaggctcatgagcgaatccacactggcgagaaaccatacaaatgcaatgcatgtggcaagagctttagttacagctcacaccttaatattcattgtagaatccacacaggagagaaaccctataagtgtgaggagtgtgggaaaggtttcagtgtgggttcacaccttcaggcccatcagataagccacactggagagaagccatacaaatgtgaggagtgtgggaaaggcttctgccgggcctcaaatctgctggaccatcaaagaggccatactggagagaaaccgtatcagtgtgatgcatgtggtaagggcttcagtcgtagctcagattttaacattcattttagagtccatacaggggaaaaaccctataaatgtgaggagtgtggcaagggcttcagccaggcctcaaatcttctggcccatcaaagaggccacactggagagaaaccctacaaatgtggtacatgtgggaagggcttcagtcggagctcagatcttaatgtacactgtagaatccacacaggagagaaaccctataaatgcgagaggtgtggtaaggccttcagtcagttctccagccttcaggtgcatcagagagttcacactggagagaaaccatatcagtgtgcagagtgtgggaagggcttcagtgtaggttcacagcttcaagcccatcagaggtgccacactggagagaaaccctatcaatgtgaggagtgtgggaagggcttctgtcgggcctccaattttctggcacatcgtggagtccacacaggagaaaaaccataccgatgtgatgtgtgtggtaagcgcttcagacagagatcctaccttcaagcccaccagagggtccacacaggagagagaccatacaaatgtgaggaatgtgggaaagtcttcagctggagctcataccttcaagcccatcaaagagttcacaccggagaaaaaccatacaaatgtgaggagtgtgggaagggcttcagttggagctcaagtcttatcattcatcagcgagtccatgctgatgatgagggtgacaaggactttccttcatcagaggattcacacaggaaaactcgataaaatatgttttactatctcagatgggtgctgaaatattttaataatcagagctatcatagacaaaacatttgttttatagagtcagtagttcagccaagtgattgggagaccacacagcagagaagcctcacaagagtggagacatatggactgcattcagaacattgaccattagctgatacatgcagacaagaggatcaggaaggatgagtctgatctggagtaaatcagaagtactaagatagaaatgctgaattc

SEQ ID NO: 202590 - DNA, 2912 bp, Homo sapiens
  Payload ID: 19951
  Gene Name: zinc finger protein 45
  Uniprot ID: Q02386
  ENST ID: ENST00000615985
  CDS Start-End: 108-2156
agctgagcataggcacagaagtttaggtgtttggaccaaggtcacacaactgatacaacagtagcttcttcacagacttggcacttctccagaaggaggaggacaaaatgacgaagtctaaggaggcagtgacattcaaggacgtggctgtggtcttctctgaggaggagctgcaactgctggaccttgcccagaggaagctgtaccgagatgtgatgctggagaacttcaggaatgtggtctcagtggggcatcagtccacaccagatggcctaccacagttagagagagaagaaaagctgtggatgatgaagatggcaacccagagagataactcctcaggagccaagaatctaaaagagatggagactcttcaagaagtaggattaaggtacctgcctcatgaagagcttttctgctcccagatctggcaacagattacaagagagttaatcaagtatcaagattctgtggtaaatattcaaagaacaggctgccagttggaaaaacgagatgatttgcactataaagatgagggattcagtaatcagagttcccatcttcaagttcacagagtccacactggtgaaaaaccctacaaaggagaacattgtgtgaaaagtttcagctggagctctcatcttcaaattaaccaaagggctcatgcaggagagaagccctacaaatgtgaaaaatgtgataatgccttccgtcggttttcaagtcttcaagcccatcagagagtccacagtagagcaaaatcatacacaaatgatgcaagttacaggagttttagtcagaggtcacatcttccccatcatcagagagttcccactggagagaatccatacaaatatgaagagtgtgggaggaatgttgggaaaagctcacattgtcaagctcctctgatagttcatacgggagagaaaccctataaatgtgaggagtgtggggtgggcttcagtcagagatcatatcttcaagttcatctgaaagttcacactggaaagaaaccatataagtgtgaagagtgtgggaagagcttcagttggcgttcacgactgcaggctcatgagcgaatccacactggcgagaaaccatacaaatgcaatgcatgtggcaagagctttagttacagctcacaccttaatattcattgtagaatccacacaggagagaaaccctataagtgtgaggagtgtgggaaaggtttcagtgtgggttcacaccttcaggcccatcagataagccacactggagagaagccatacaaatgtgaggagtgtgggaaaggcttctgccgggcctcaaatctgctggaccatcaaagaggccatactggagagaaaccgtatcagtgtgatgcatgtggtaagggcttcagtcgtagctcagattttaacattcattttagagtccatacaggggaaaaaccctataaatgtgaggagtgtggcaagggcttcagccaggcctcaaatcttctggcccatcaaagaggccacactggagagaaaccctacaaatgtggtacatgtgggaagggcttcagtcggagctcagatcttaatgtacactgtagaatccacacaggagagaaaccctataaatgcgagaggtgtggtaaggccttcagtcagttctccagccttcaggtgcatcagagagttcacactggagagaaaccatatcagtgtgcagagtgtgggaagggcttcagtgtaggttcacagcttcaagcccatcagaggtgccacactggagagaaaccctatcaatgtgaggagtgtgggaagggcttctgtcgggcctccaattttctggcacatcgtggagtccacacaggagaaaaaccataccgatgtgatgtgtgtggtaagcgcttcagacagagatcctaccttcaagcccaccagagggtccacacaggagagagaccatacaaatgtgaggaatgtgggaaagtcttcagctggagctcataccttcaagcccatcaaagagttcacaccggagaaaaaccatacaaatgtgaggagtgtgggaagggcttcagttggagctcaagtcttatcattcatcagcgagtccatgctgatgatgagggtgacaaggactttccttcatcagaggattcacacaggaaaactcgataaaatatgttttactatctcagatgggtgctgaaatattttaataatcagagctatcatagacaaaacatttgttttatagagtcagtagttcagccaagtgattgggagaccacacagcagagaagcctcacaagagtggagacatatggactgcattcagaacattgaccattagctgatacatgcagacaagaggatcaggaaggatgagtctgatctggagtaaatcagaagtactaagatagaaatgctgaattctgttccactagaatataagatccaagagggcagggactttgttgactgccaaatctactctgccttttcagtgcctaatacgttgtaatttttcagtagtatttgaaattactgtcatatttgaaattcagtaatatttgacatttttatttatctctagaagtttctctaaaattgtactcagaagaattctgcaaggcttggaggatatataagttagtcatatggcctgattttcccatttttgcagatctcgtggacaagtgtttatcaaactgaaggttgcagcttgttagtgggttcagaaatcagtttctggctagcaactagaagttttgtatgttaacagtactttattgaggtgtaatctgcatgcagtaacatgcacaagtctcaagttcatggctttctgaattttgacaaatgtaatcatcaccaagatcaatgtatacaatatgtctattaaaccaaaaagttttcttgtgcccatttccagtc

SEQ ID NO: 202591 - DNA, 4998 bp, Homo sapiens
  Payload ID: 19952
  Gene Name: zinc finger protein 451
  Uniprot ID: Q9Y4E5
  ENST ID: ENST00000357489
  CDS Start-End: 225-3266
ggaagcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggttcgatcactctccatgtgatccaacaattacactacatggacctttcttcagctcctttgcttgtgtagtatgttataaaaaatttgttactcaacaacaatatagagatcacctttttgataaggaagccacagatgatggacataacaacaaccttcttcctcagattattcagtgttttgcatgtccaaattgcttccttctttttagcagaaaggaggagtgttcaaagcatatgtctggaaagaatcatttccatcagagtttcaaactgggtgataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcagagttcattgtcgaaatgctggacctgtagctgtagctgagaagagcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaactgaaacaggcaataaactattcaaaaagtttagacatggagaaaggagttgagaatgacctaagctatcagaatataggaggaaacaccaattggaagcctccgctcaactgtaagatttataactacctgaacaggattggatgcttcttccttcatcctcgctgtagtaaaagaaaagatgctgctgattttgccatatgtatgcatgctggccgtctagatgaacaactacccaagcaaattcctttcaccatcctctcaggagatcaaggttttctggagctagagaatcaatttaagaagactcagaggccagctcatatactaaaccctcaccacttagagggagatatgatgtgtgccttgttaaatagcatatctgataccaccaaagaatgtgacagtgatgataacatgggtgccaaaaatacttcaataggagaagaatttatatccacagaagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattc

SEQ ID NO: 202592 - DNA, 458 bp, Homo sapiens
  Payload ID: 19952
  Gene Name: zinc finger protein 451
  ENST ID: ENST00000370702
  CDS Start-End: 178-399
gtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgggtcggcgctttgcctgatgaccctacctctctgacagatctgagaagagtttactcttcagcttttaagtgaataaagatgataaatgtccta

SEQ ID NO: 202593 - DNA, 5268 bp, Homo sapiens
  Payload ID: 19952
  Gene Name: zinc finger protein 451
  Uniprot ID: Q9Y4E5
  ENST ID: ENST00000370706
  CDS Start-End: 245-3430
atcctgcgcggcgcggggaaggaagcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggttcgatcactctccatgtgatccaacaattacactacatggacctttcttcagctcctttgcttgtgtagtatgttataaaaaatttgttactcaacaacaatatagagatcacctttttgataaggaagccacagatgatggacataacaacaaccttcttcctcagattattcagtgttttgcatgtccaaattgcttccttctttttagcagaaaggaggagtgttcaaagcatatgtctggaaagaatcatttccatcagagtttcaaactgggtgataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcagagttcattgtcgaaatgctggacctgtagctgtagctgagaagagcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaactgaaacaggcaataaactattcaaaaagtttagacatggagaaaggagttgagaatgacctaagctatcagaatatagaggaagaaattgttgagcttccagatttggattacctgcgaaccatgactcatatagtctttgtagattttgataactggtcaaacttttttggtcatctaccagggcatctaaaccaaggaacatttatttggggctttcaaggaggaaacaccaattggaagcctccgctcaactgtaagatttataactacctgaacaggattggatgcttcttccttcatcctcgctgtagtaaaagaaaagatgctgctgattttgccatatgtatgcatgctggccgtctagatgaacaactacccaagcaaattcctttcaccatcctctcaggagatcaaggttttctggagctagagaatcaatttaagaagactcagaggccagctcatatactaaaccctcaccacttagagggagatatgatgtgtgccttgttaaatagcatatctgataccaccaaagaatgtgacagtgatgataacatgggtgccaaaaatacttcaataggagaagaatttatatccacagaagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattcatactttgactttaatttagacacaaggagatgtaatcgctgtgtaacatcagagaaagctatatggattatcgtcagaagtaaatgtttctaacattgacaaaga

SEQ ID NO: 202594 - DNA, 9478 bp, Homo sapiens
  Payload ID: 19952
  Gene Name: zinc finger protein 451
  Uniprot ID: Q9Y4E5
  ENST ID: ENST00000370708
  CDS Start-End: 179-1858
agtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatagaatgcctgaatctaaggtgccatcctctgagaatcatcgcccagaaatgtgctctagctgcaatgttcctcttcccattggagatagcagctccttctctgggagttgttccagcagtccagaaaggatagtttctcaaacttcctctgttgagaacccattggagaaccagaaaaatgatcaaaataattcagatactaagatctctgagacagagacccttaaatcatcacagaattttcagactctgccttcatctccacttctggtcccccaagaatctttggcctcttctgaggtcaaagagaatttacgtatagattcttcttcagcttcacagcatggacgggatgccatcctctatctccagacacaagtagctgaaatgtcccgagtgatacgtgatctgcagtccaggagctgttttagatttcatcattctaggccaagtgagaactcctcagttccttgggacatctccacctctaaagaggaaaatttatccacagttgaagaagaaactgattacaaatcaccatcagctgatgacaaagggcagccatctgaccccagccaatctagtttcacaggtcttttgaagagaatggaacaaagaggtgttataaaaagggtgacattacaatctgaagcggagtcatgtgaagggaaacctgattgtgtgacttctaaaaaacgtttggttcctccattgcatcctcttctgagaattgccaccactgaggtttttaaagaccctgctgattgccatccttcttccttcatgggacacagggtatatcctgtggccaaggacacctctcctttccaaccaaacccaccagctgaaggccccattgtagaagcattagaacacagcaaaagaggaaacacaacatcccctctagattctacctcaaaagaaatggaggtcatgggttgtaggttttaccacgctgcctccattgcagcccgagctgctagctacatggcctatatgactcaatatcagcgtaaactctgggaagacatggaagatctggttcatgacccagaatttgatcgtggaaaagcaagatgcataatatctgatggtatggatgcaggcctttggcaactttgtactactagggacataatggactctgtagtcagagttatggccatggccatagactatagacggcaggcctggcttcgacttacatctctcactaagaaaacccaggagaagatctcccacttgccctttgatggtacttccctttttggacaagatgtgaaagctgttgttgcagaagacaacaatataaaagaaaatgactataaagatcacaaatactataatcagcatcgatacttttatagtcatgatcagaaagcacattatcacaatagaggatactccaaaggggattggtacaaacctcgaaaccacccctatagatatagaaagaagggagactctccagaacgccatgggtacaagaattaataacctgtttaatgttcagcagagtagtcattcaagatcctaactattttacttgttcctccttgtacaaataggatctacaggtaggagatcatctcaaaaactggatgcatgtctggaatgatcacagctgacatttgaattctagacttttgaaatgaagtatataataaagaaactcatgacttattggccaagtgagcagtggagactttcttgaaagggttggacaaatgtttatcctttatttctggtccaaaaataagtgtggaggaggaccactcaggaatctgaatcctcttgtgattaaagaaaaatataaagatgtgttcctcaggaaaatcttatttgtaaactgaggactagcagattttgaatctagaaataatactagatgtctgtttactaagaccagaggtaaatccttaacttttaggttatcagtgcttccttgttcaggcttcagtttgacagatcttcacaaaatgacacatctgttaaaatgtctttatgtcaagatggtcaactcaccaagagtccgtactactatcaagctctgtgagacttcagaatcagccatgaagctttgtgtcaactggaattcaaatcaaattttgccaaatccagtttgcttccccttggaatggctagatgtcgcaggtctattatggacaccaactggaaaaagacttctacctgtaacatctctgtagaaattgcacagtaactatcttcatcaagactttgatggccaccataccatcactactcataaagctacatgtgagagaattgtttgttgttatcaatcctaatagtctttgacctatcaagctctcgtatcaagctgtaagactgagtcatggtagtctctcactgtaagctgggcctttcaccaagatggccttcttaaacaacctaccttctaaacatttaattcttttgagcttgatagtgcatcacactctaaatacaaaaaagatacgcacatcagtgccctggaaataaaggatgttacacgatccaggcatgcaaatctgaactcctaagaccaagaattccaaacatgcctgacaatcttgtccccttattgtaataaagagggataccatcagtctagattttattgagaatccttaagatttaaagcatagctgtggatgtggtgaagagaacaagccacacagctctgtttctggatatctaagtgatgatatccattaatgatttgaaaggctgaaatcaagatttaagtgatacgctcttggttaattggttacttaatttagtcagattcttagtgtaagagacagcttatctttttgctcccaattggtcccattaatagtttttcaccatactggaactggcagcagatacctcaattatatgtcccacagtatcttctctttagactcaaggtagtggatgtatggtatatcagcccttagatccatgtcttcacagcatgacatcaggaatggagaatatgtcaaatttgaggggtctgaatacatcacctagtattatttgcttggcagccaaaaacagttgtttttattgacagacttaattctgtaacttctgcgttttttcatctgcttgatcaaggcattttggatgtactgctaatggaatatggcactgttttacggtttatgtggcttctgttcttgccacagttgttgcacagtggtaattgatgttttctctggtgccacactttttaataatctattggaagctcattcctcctcccccatcataaccatattcagcacccatttttaaatctacttttcttccttatttgtgctacagaggttgatggcgtaaattttcctacttggaagaaattactttatcagttaatttcagggtactgtattgatcttgtttgtcctatttgtagattaaacttgaactagtcttaataaaggggatattgttttgcaaatttagcccagtcatatcaagagttaatatttatcttatttttctgtattttactcaaaattttatttccacttctgtagaaataggtccatgccagtgttctctacaaagtgtctttcaaactaaactctagaagaatatcgattacctgaacagaaacaaaggcctaagaaatcatacatttttgtagcttatgtgtattgcaccaatcaagcaatcccatgtgctcttgatattggcactgtagttttatcttagaggacttgccactggagaactcagtggtgagagaccttggaaatgttttatgtggctgcacataagtgtttctgactagctaaggctacttcagacttttcactttccatttgtccccttttccttccctgaattagatgctatgtcataaacttggtggtttttgaaatactcttatttcaaaccttaaactaaaccgaaataagttatgcctgagaatgcgtttgtctgaaacgattttggcacttccctttaatatgcttccccttccctttgccttttaaattgtggttaaaaaaaaagaaaaaaaaaggcacataaagctgagcaccttaaccattttttaagcgtatggtagtgttgactatatttgcattgttgcgcagctcctccattcttaaatatttgtaagatgatgttgctgttctcttttcctcctgtgatatttatgttgcccagtaataagtaaaagtatcctttcttagttactctaactgatatgcccaagtgtctccagatactctgttttcctggaagtgtaaaggtattgggaaattatcaaattggtgaccaagtagttctgaaaggatttgaccgtttaatagggatggggacagaatgcagatcaggaagagtttttagtaatagattagtttcttgattgcaaaagaaatatctttaatgtgttaattttttattattttaaaatctctggcatacttgaatgataatgttataaaacttaaagtgaggatttggtctagggagattaccccaatagaatcagaaactcttagtcagataataaatcctcatattatgcctgccatgttcagaacctgcaacaaaattccctactaggccaacctctaacgtttaaatacctctaggttttctaggaggccttggaatagttgcaagtttaatgatctggtattctcaaaaaggatgtatctaatgatcttgattcttcaaaatgttatttcttgattagatatacaatgtatatagagacaatatggtttcttgtagttactgtgtatagagaagtactgtttccatttttatatgaagtgcctttttaattctacacttttctttaaaacttaaactttgatgtcttgcatatattgctggtggtatttatgtgaattttgtacagtgatttaatcttgtagtttatcatttgtacaattgcactatctaaatgtactcccttctgaatgttaatttgttttctttatagcactgttgattcatttcagaaggttgtagagtatacctccctcccccttatttaactaactagacagtagttcctttttgttattagtgagtggctaattttggggggccttaaggcagctttgttttctatagatatgctctaggttttctgattgtctcgtatctaaccttgttcttagccatgataacacaacttatatttgataagtggatgtgtttacttggttagaataagcaaggacatttttaaaaagcagtaaatttgctgacacttttatctttttttaaaagaatgaatgacagcttccttatcagtataattacatttaaacttttttttttaaaccgtgtggcagcttctttatcaatcagtataattccatttatttacttagccctcaaaatgacattttgaagggagcataaactctttcaggctacttggacagtatttagtattctatattagtactacactaataatttactgagtgctacctaagtgacctgattgataatgtccttaaggacctgatacatccaggataacctctcaggtactgtaaacaaggaggttgaaaaagacacattccggaatccctttgtctggtaaaattggatactgatgtggatggacatgacattcattattcttgaagatataactagttgactgggattctgatgaaggtttgaaattatggattagatctttgtagaagtagtttaaagattgcaataagtgaaatcttttttttttttttttttttgagacagtttcgctcttgttgcccaggctggagtgcaatggcacgatcttggctgactgcaaccgccacctcccgggttcaagcaattctgtctcagcctcccgagtagctgggattacaggcatgtgtcaccatgacctgctaattttgtatttttagtagagacggggtctctccatgttggtcaggctggtctcaaactcctgacctcaagtgatccgcccgccttggcctcccaaagtgctgggattataggcgtgagccaccgcgcctggctgtgaaattttttttttttttttttttatgtgaggcatattttgccacagtctcgcactgtttaggttctcttgtcttttggaatctatcattctgtatttaatgttagtggctagtccaataattgattgtctcatctgtatgcatcttatgcatgtgattcaatagactagatcgattctgtgtggtttatcatagtagatacacaaaccagtctttattttttacttaagaaaatatataagtggaagttatcagtaaactggtgattattgtattgaatgcaaatctttttattatttttccagatatattgagttttataaaccattaaaatattattttatgaaatttcccttcctggatgaacagaatattgttttattaaatcttctcttattagtggaatattttttacttctttgtcttttcatttacttgttttttgttataatgaaaactttactagtgtttggtaccattgagataacttattactggaaattttgtttgcttcctgtgggatatatctggaagtggtcatagtccaaccatgtccttttgatgttgttagcatatcagttattctatgtattgatcttttcttctcctgtattcaacacctctttctgaaaggatgtctgatcttcccataatcgctttgatgtagatgatatttttattctatcagtgtatactagacaggattttgatgtggctttgtatttgtatatttaaataccatgtctttaaagcattattagaagagatattctagtttcttctaatgtcccttttaaaaaaaatatagccagtccaatatctcaaactactttgatttttgaacttaaatcaacttttagtgctaccttgtttaatggtagtagtattttctcatttctacatgttcacacaagtttattatatatagtttatggtcatatgtatcttataaaaattttgaagcccatccccatggatttattataatacagctctgatatatcttaaagttaacccgttttccgtagatgttaagggctttactggttgaggtaacctatttcaaatggtctgttgggttttgtggtaccttgtcaagaattcaataagaattctcaggctgtctgtattttcttttaggactttggagatctctcaagttgtactgttttctagtattcctgagtatattcctttggtaacgtgaaagtaaatagtttatatttgatgattttttttttttttttttgagacggagtcttgctctgtcacccaggctggagtacagtggtgagatcacggctcactgcaagctctgcctcccgggttcacgccattctcctgcctaagcctcctgagtagctgggactacaggcgcccgccaccacacccggcgaattttttgtatttttagtagagatggggtttcaccgtgttagtccaggtggtctcaatctcctgaaccttgtgatccacctaccttggcctcccaaagtgctgggattacaggcgtgagccacagtgcccggcctgtatttggtgatattttaaaaaattctactttgaccttaagtgcttcaagaattgtgttcagttagtagtccttttgtaagactaactttcatatgctatctttgctccatgagctatcatagtactgttttctttcattacccgtaagagtggctctatcacagcatttactgttaagggctacagttagacctcttgttaactctacttttatttgtgatggctgtgtttcacactaccttgatttataaatgtagtaatgtgttaaataactatatgttgtggtcccttaatacctcttttgattggtgaggtaacagtgatgtggatgatgaaataaaaacgtttccccaagtcactaaacacagttttcaattcatttttttttacatatttaatttacatctaactactgttaggtatgcagcccgttcctttttgccttcagtagaatatagttatataagtagtctcatttagattcttgggacagaacggcctgtgtattgatctttctttaatggcttggaacagcttctatatattctgacaggtcttggaagcatgttaatatccgtgtgtttaattgtcatcttcctgcctgggaaggcagtagaagaaagaatctacatttgtatagtctgtagtacaggctctgtgctgattgcaaggcactcttgagagaaattcattcttattttgcagaagaagaactgaaacttcattaagtcattaagcaacttgctcaggtggtggaactgagctttaaatatggactttttccagtctcaattcagcattatactaggctgcctccatgtgtttttcaaagccccattcaagttttacttctatggtaaactaattttacatacacaaatcttttcattttctgaacttcctttatggctttactgtcaccccactagtatttgatgtcttagctattaactaattcctgattatttcacttgtcacatcaggaaccctatcctcttagttctcccattgagatttcactgctggactaagattattcttgattcgtagtcattggtttctgtttccattcattttcagcactgattatgttaatcgtattgcttgagttttttctttgttcaatgttgtttattacattcattttgtttcatatacacacattttttttttttaactggcattttgaggatattggtttaatggaaggaaaaaggaatggtgcaaagcacatggtatttgaattccaaagaccttgaccctcagcattagcaagtcacttgttttctgagcctcagttttcttactctcaaatgaggtaatatccgaaagtactttgacaacacactaaagcctgatgcagatttcctttttgaagtaattgtgctgtttctattcatattggatatggtattctatggtattggctatagatacatacattttaaaatgttatttaacagcatgtaaatgttcatttcatgccatgtgatcatgttcccctttatgattttttaaggctgtcttacaagcctaacagtgtactaagtcattaaaagatatatttaaagtaaaa

SEQ ID NO: 202595 - DNA, 375 bp, Homo sapiens
  Payload ID: 19952
  Gene Name: zinc finger protein 451
  ENST ID: ENST00000370710
  CDS Start-End: 48-275
gcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgtgccctatacaacaggattcttttgttccagaaccacatgaccacagaaaatttgttttctcttagaaaaaaggatatgtagagatccttttaggaatggaaagtgggggaagggtttataggggatatattacttcagtc

SEQ ID NO: 202596 - DNA, 3632 bp, Homo sapiens
  Payload ID: 19952
  Gene Name: zinc finger protein 451
  ENST ID: ENST00000491832
  CDS Start-End: 66-3191
ttcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggttcgatcactctccatgtgatccaacaattacactacatggacctttcttcagctcctttgcttgtgtagtatgttataaaaaatttgttactcaacaacaatatagagatcacctttttgataaggaagccacagatgatggacataacaacaaccttcttcctcagattattcagtgttttgcatgtccaaattgcttccttctttttagcagaaaggaggagtgttcaaagcatatgtctggaaagaatcatttccatcagagtttcaaactgggtgataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcagagttcattgtcgaaatgctggacctgtagctgtagctgagaagagcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaactgaaacaggcaataaactattcaaaaagtttagacatggagaaaggagttgagaatgacctaagctatcagaatatagaggaagaaattgttgagcttccagatttggattacctgcgaaccatgactcatatagtctttgtagattttgataactggtcaaacttttttggtcatctaccagggcatctaaaccaaggaacatttatttggggctttcaaggaggaaacaccaattggaagcctccgctcaactgtaagatttataactacctgaacaggattggatgcttcttccttcatcctcgctgtagtaaaagaaaagatgctgctgattttgccatatgtatgcatgctggccgtctagatgaacaactacccaagcaaattcctttcaccatcctctcaggagatcaaggttttctggagctagagaatcaatttaagaagactcagaggccagctcatatactaaaccctcaccacttagagggagatatgatgtgtgccttgttaaatagcatatctgataccaccaaaggtacgcagctgcagtcacagtgcaaaccacccaagaggaggagacttcactgctgagagaaaccaataaactgctgtccgctagtgaactgttgcctgcttgctaaaccatcatgttctcttacttctatcttacttatcttttttaaaaaaatctcactttcattctttagtgttttagaaggaggatgaattcataataattttctggagctttttttgatctagtagataaaatctatattgatgtatataaaacatatattcatgtgttacagtatgttactacaattttaaaagctcagaattcagatcttcactttgtttctgaaattccaagttgaccttcagttttttagaaagcagtgcgcttagaggtgaaaaccagaaagcaataacaaaggtgatcatttaagaggttgacagtgacaaaataaaacgctgataggcttttaggtccttagagaagtgggtacatcctatcttattgctgggact

SEQ ID NO: 202597 - DNA, 538 bp, Homo sapiens
  Payload ID: 19952
  Gene Name: zinc finger protein 451
  ENST ID: ENST00000508603
  CDS Start-End: 86-538
ggtgcagggcgggaaggggattcgtggcgacggcggcggcagggacagcaggagcagtggtgctgtcagcgcggccgtcggagacatgggagacccggggtcggaggaaggaccattacgacctgttcttgaatacattgatctggtcagcagtgatgatgaagagcctagcacctcttatactgatagaatgcctgaatctaaggtgccatcctctgagaatcatcgcccagaaatgtgctctagctgcaatgttcctcttcccattggagatagcagctccttctctgggagttgttccagcagtccagaaaggatagtttctcaaacttcctctgttgagaacccattggagaaccagaaaaatgatcaaaataattcagatactaagatctctgagacagagacccttaaatcatcacagaattttcagactctgccttcatctccacttctggtcccccaagaatctttggcctcttctgaggtcaaagagaatttacgtatagattcttcttcagcttcacagcatggacgg

SEQ ID NO: 202598 - DNA, 790 bp, Homo sapiens
  Payload ID: 19952
  Gene Name: zinc finger protein 451
  ENST ID: ENST00000502749
  CDS Start-End: 44-262
ggacagcaggagcagtggtgctgtcagcgcggccgtcggagacatgggagacccggggtcggagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggttcgatcactctccatgtgatccaacaattacactacatggacctttcttcagctcctttgcttgtgtagtatgttataaaaaatttgttactcaacaacaatatagagatcacctttttgataaggaagccacagatgatggacataacaacaaccttcttcctcagattattcagtgttttgcatgtccaa

SEQ ID NO: 202599 - DNA, 581 bp, Homo sapiens
  Payload ID: 19952
  Gene Name: zinc finger protein 451
  ENST ID: ENST00000515290
  CDS Start-End: 462-581
aacgcaatgatgggccctcttcaagatcttaacttataaggcaaaataatggattcacagctcagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggag

SEQ ID NO: 202600 - DNA, 561 bp, Homo sapiens
  Payload ID: 19952
  Gene Name: zinc finger protein 451
  ENST ID: ENST00000504603
  CDS Start-End: 30-191
gtggtgctgtcagcgcggccgtcggagacatgggagacccggggtcggagataatagaatctgtccctccagctggccctgaggcatctgagtcaacaacggatgaaaatgaagacgacattcagtttgtcagtataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcagaatgtgacagtgatgataacatgggtgccaaaaatacttcaataggagaagaatttatatccacagaagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtattttt

SEQ ID NO: 202601 - DNA, 719 bp, Homo sapiens
  Payload ID: 19952
  Gene Name: zinc finger protein 451
  ENST ID: ENST00000510483
  CDS Start-End: 245-719
atcctgcgcggcgcggggaaggaagcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggaggaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctct

SEQ ID NO: 202602 - DNA, 609 bp, Homo sapiens
  Payload ID: 19952
  Gene Name: zinc finger protein 451
  ENST ID: ENST00000370711
  CDS Start-End: 116-343
acgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgtgccctatacaacaggattcttttgttccagaaccacatgaccacagaaaatttgttttctcttagaaaaaaggatatgtagagatccttttaggaatggagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagac

SEQ ID NO: 202603 - DNA, 2332 bp, Homo sapiens
  Payload ID: 19953
  Gene Name: zinc finger protein 454
  Uniprot ID: Q8N9F8
  ENST ID: ENST00000320129
  CDS Start-End: 304-1872
gcagttcggctcccggctgcagactccagctcattgtgttctgactgcgatgtggcgcttgcgatctctcgccgccggcagaggctcctcgaagagcgacacggggctgaccaggcacggtggtcaaagccgcagagggagagcgggagcggtcgtgaggtcgtctggggagaagggcggaggcaaagccgaggagcaggtgtgtggacccttctagcctgaggagtcctgcaggtgtgaagctccacacctgcctccatagcactttgcctgtccctaagagggctcatcggagaagaaagaatggctgtcagccacctgccaaccatggtccaggaatcggtgaccttcaaggatgtggctatactgttcacccaggaagagtgggggcagctgagccccgcccagagggccctgtacagggacgtgatgctggagaactacagcaacctggtctcactgggactcttaggacccaaaccagatacgttttcccagctagaaaaaagggaagtgtggatgccagaggacacccctggaggcttctgtcttgactggatgactatgcctgccagtaagaaatctactgtcaaggcagagattcctgaagaagaattggatcaatggacaataaaggaaagattcagtagcagtagtcactggaagtgtgctagcctgctggagtggcaatgtggaggccaggagatcagtttgcagcgagtggtactcactcaccccaacaccccatcacaggaatgtgatgaatccgggagcactatgagctcatctcttcacagtgatcaaagtcagggatttcaacctagcaaaaatgcctttgagtgtagtgagtgtggaaaagtcttctctaagagttcaactcttaataaacatcagaaaattcataatgaaaaaaatgcaaatcagaaaattcatattaaggagaaaagatatgaatgtagagaatgtgggaaagcctttcaccagagtacgcaccttatccatcaccaaagaattcacactggcgagaaaccctatgaatgtaaggaatgtggcaaggccttctcagtgagctcctcacttacgtaccatcagaaaattcatactggagagaagccttttgaatgcaacttatgtggaaaagcttttatccgaaatatacaccttgcccatcatcatagaatacatactggagagaaaccttttaaatgtaacatttgtgaaaaagcctttgtgtgcagggcacaccttaccaaacaccagaatatccacagtggagagaaaccctataaatgcaatgaatgtggaaaagcctttaatcagagtacaagtttccttcagcatcagagaattcacactggagagaaaccctttgaatgtaatgaatgtgggaaggccttcagggtgaactcttcccttactgaacatcagagaattcatactggagagaaaccttataaatgtaatgaatgtgggaaagctttcagggataattcatcctttgcacgacatcggaaaattcacactggagagaaaccttacagatgtggcttgtgtgagaaagcctttcgggaccaatcagcactagcccaacatcagagaattcatactggggaaaaaccttatacatgtaacatatgtgaaaaagccttcagtgaccattcagcccttacccaacataagagaattcatactagggaaaaaccttacaaatgtaaaatctgtgagaaagcctttatccgaagcactcacctgactcaacatcagaggattcacacaggagagaaaccctataaatgtaataaatgtgggaaagcttttaaccagactgcaaacctcattcagcatcagagacatcatattggagagaagtgatatgaatgcagtttgtatggaagacctttgagactgagtagatgaattattgaatgtgagataatccgttctagagaataactatgaaagcttgcatcaagatagtcactttatttactgagggtcaggtttcacagtgtcatggggtttgggcatttaagaatggcaaacactcggctgggcacagtggctcacgtctgtaatctttgggagcactttgggaggccgaggtgggcggatcacgaggtcaggagatcgagaccatcctggctaacagggtgaaaccccatcgctactaaaaatataaaaaattacccgggcatggtggtgggcgcctgtagtcccagctactcgggaggctgaggcaggagaatggcatgaacccgggaggcagaggttgcagtgagccgagatcgtgccactgcactccagcctgggcgacagagcaagactcagtctc

SEQ ID NO: 202604 - DNA, 2142 bp, Homo sapiens
  Payload ID: 19953
  Gene Name: zinc finger protein 454
  Uniprot ID: Q8N9F8
  ENST ID: ENST00000519564
  CDS Start-End: 330-1898
attgtgttctgactgcgatgtggcgcttgcgatctctcgccgccggcagaggctcctcgaagagcgacacggggctgaccaggcacggtggtcaaagccgcagagggagagcgggagcggtcgtgaggtcgtctggggagaagggcggaggcaaagccgaggaggtgcgggttgtggtccattctggaggacgctgatcgaatgccccaaacttcccggaatcaggtgtgtggacccttctagcctgaggagtcctgcaggtgtgaagctccacacctgcctccatagcactttgcctgtccctaagagggctcatcggagaagaaagaatggctgtcagccacctgccaaccatggtccaggaatcggtgaccttcaaggatgtggctatactgttcacccaggaagagtgggggcagctgagccccgcccagagggccctgtacagggacgtgatgctggagaactacagcaacctggtctcactgggactcttaggacccaaaccagatacgttttcccagctagaaaaaagggaagtgtggatgccagaggacacccctggaggcttctgtcttgactggatgactatgcctgccagtaagaaatctactgtcaaggcagagattcctgaagaagaattggatcaatggacaataaaggaaagattcagtagcagtagtcactggaagtgtgctagcctgctggagtggcaatgtggaggccaggagatcagtttgcagcgagtggtactcactcaccccaacaccccatcacaggaatgtgatgaatccgggagcactatgagctcatctcttcacagtgatcaaagtcagggatttcaacctagcaaaaatgcctttgagtgtagtgagtgtggaaaagtcttctctaagagttcaactcttaataaacatcagaaaattcataatgaaaaaaatgcaaatcagaaaattcatattaaggagaaaagatatgaatgtagagaatgtgggaaagcctttcaccagagtacgcaccttatccatcaccaaagaattcacactggcgagaaaccctatgaatgtaaggaatgtggcaaggccttctcagtgagctcctcacttacgtaccatcagaaaattcatactggagagaagccttttgaatgcaacttatgtggaaaagcttttatccgaaatatacaccttgcccatcatcatagaatacatactggagagaaaccttttaaatgtaacatttgtgaaaaagcctttgtgtgcagggcacaccttaccaaacaccagaatatccacagtggagagaaaccctataaatgcaatgaatgtggaaaagcctttaatcagagtacaagtttccttcagcatcagagaattcacactggagagaaaccctttgaatgtaatgaatgtgggaaggccttcagggtgaactcttcccttactgaacatcagagaattcatactggagagaaaccttataaatgtaatgaatgtgggaaagctttcagggataattcatcctttgcacgacatcggaaaattcacactggagagaaaccttacagatgtggcttgtgtgagaaagcctttcgggaccaatcagcactagcccaacatcagagaattcatactggggaaaaaccttatacatgtaacatatgtgaaaaagccttcagtgaccattcagcccttacccaacataagagaattcatactagggaaaaaccttacaaatgtaaaatctgtgagaaagcctttatccgaagcactcacctgactcaacatcagaggattcacacaggagagaaaccctataaatgtaataaatgtgggaaagcttttaaccagactgcaaacctcattcagcatcagagacatcatattggagagaagtgatatgaatgcagtttgtatggaagacctttgagactgagtagatgaattattgaatgtgagataatccgttctagagaataactatgaaagcttgcatcaagatagtcactttatttactgagggtcaggtttcacagtgtcatggggtttgggcatttaagaatggcaaacactcggctgggcacagtggctcacgtctgtaatctttgggagcactttgggaggccgaggtgggcggatcacg

SEQ ID NO: 202605 - DNA, 3350 bp, Homo sapiens
  Payload ID: 19954
  Gene Name: zinc finger protein 460
  Uniprot ID: Q14592
  ENST ID: ENST00000360338
  CDS Start-End: 323-2011
gaaacagtgtggggcctagagcgctgggtgggcgcgttctgcggcctgagcagggacgggtagtgaagcggttacgccccttcttcgcgtcttggcgggagcctgacgccccgcttctcccctaacgaggtgtcccaccggcgcccgccgaggcctaggcctccgcagccgccctccgtctcctcagccccgacgctgcgccttgggccttgtgcgcatttttttcgggggaaaactgaggctcggagtgcgaaagtcagccgaggtcgccccgcccaggacagagaagggctgtggtcggctgatccgcggcattcccgggatggcggcggcgtggatggctccggcgcaggagtctgtgaccttcgaggatgtggctgtgacatttacccaggaggagtgggggcagttggacgtgacccagagggccttgtacgtggaggtgatgctggagacctgtgggcttctggtcgcactgggtgacagcacaaaacctgagaccgtagagcctatcccttctcatctggccttgcctgaggaagtctcactccaggaacagctggcacagggagtcccaagatactcctatttggggcaggccatggatcaagatgggccatctgaaatgcaggaatactttttgagaccagggacagacccacagagtgagaaactccatgggaaaatgagccttgaacacgaaggtttggcgacagctgatggtatttgttcaatgatgatacagaaccaagtctcaccagaagatgctctctatggatttgactcatatggaccagttacagattccttgattcatgaaggggaaaattcctataaattcgaggaaatgtttaatgagaattgcttccttgttcagcatgagcagattctccctcgtgtgaagccctatgattgcccagaatgtgggaaagccttcggcaagagcaaacacctccttcagcatcacatcatccatactggggagaagccctataaatgcctggagtgtgggaaagacttcaaccgcaggtcacacctcacacggcaccagcggactcacaatggagataagccctttgtgtgcagtgaatgtggaaggaccttcaatcgcgggtcgcaccttacacggcaccagcgggttcacagtggagagaagccttttgtgtgcaatgaatgtggaaaggcctttacctaccgctccaattttgtcttgcataacaagagccacaatgagaagaaacccttcgcatgcagcgaatgtggaaaaggcttttatgagagtacagccctcattcaacacttcattatccatactggggagaggccctttaagtgccttgagtgtgggaaggccttcaactgcaggtcacacctcaagcagcatgagcggattcacactggtgagaagccctttgtgtgcagtcaatgtggaaaggccttcactcactattccacctatgtcctgcatgaaagagcccacactggagaaaagccttttgagtgcaaagaatgtgggaaagcctttagcattcgaaaagacctcattcgacacttcaacatccacactggagagaagccctatgagtgtttacagtgtggaaaggcttttacccgcatgtcagggctcacaaggcaccagtggattcatactggagagaagccgtatgtatgcatccaatgtgggaaagccttttgtcggaccacaaacctgattcgacactttagcatccacactggagagaagccctatgaatgcgtggagtgcgggaaggccttcaaccgcaggtcacccctcacaaggcaccagcggattcacactgcagagaagtcccacgaacccatccagagtgggaacgtttcttgtgagagcacagatctcattcaacactccatcatccacactgagagtagcccagtgagtgcagtgaatatggaaacgccttcaattgccgctcattcctcctcactcgacatcaacggattcatagtggaagaaaccctaccattgtaacagatgtggaaagactttttacgtacacttcagtcaacatccaagaattcctattagcgaaatagttttttaatataaccactgaagaaaatctgtggtgagaggaaacatcttaccatctggtcattcatactgaagagaaactccataagtatcatctctgtgggaaaacctgttttagatcatcatttgtcatctaaacaattatgttagaaattgacacagccaagagtcttattctacatctgataattcacccatgaaagagacccagtggttactgtgcacttaggaaaaccttcagccacatctttcttattagtttacagtgaaatgttatctcagggacattcaaacaaaggaggaggagtcatagggaagagaaagaaatggaagcacagcttctttcagacttccctgacaagcccatggcaatttgtcatcccctccttattttatttgggagagggaaatgtttcagaaacaaaagggcctcatcccctttattttccctgtgtatacattcactgctgtccagtgctgtagacaaacggtttgtttgaaaacattttgtgaaagcctgctttgttccacagcattgtctccactcttgaggagcagaagcatatatctttatgagaaagatggaggcttgagttatgaaatacttttacatttaaggagataaaggatgtacatatgaatgggcacattttactgcacacttcagacgctttgacttttttaaaaaaattgtttctccgtgtgtctttaaccacccagtaccatacttttttcttgatctggatctacttgtcaatttcttctttatttttctgtaggatggagatgatattgtagctgtttgtacataatgtaatccagggagtcctaattcttccctctgattgtggtttctcagcttttttactgctctttagagagagtaaatagttcaaaattcacctcaacaattttctagaggtcaatttggaaccaaaaatgaaataagacatgtagctaaagtaagttaaaagattatgataaactcagaaaataaacacagagaaggaatctcatttttcagtcttacagaagattgtgtgaaggctgactatacataaagtgactggaattttaacaggtgaacctgcatatgtatatgcaggtagttgtcaccatggattgagtccagtcgtagtaattaatatgtttaatcagaatattttggaatttctcttttggtattctttttgtttcttttattgtttttaattgacaatgtttatggggtttggtgtgatatttcaatacatgtgtgctaagagtaatgatcaaa

SEQ ID NO: 202606 - DNA, 2037 bp, Homo sapiens
  Payload ID: 19954
  Gene Name: zinc finger protein 460
  Uniprot ID: Q14592
  ENST ID: ENST00000537645
  CDS Start-End: 168-1733
atccttttcttctatgaaaagatccagaaaagaggcaaagcaagcgagaagtcgcgggcccagcccacagcagggagtctgtgaccttcgaggatgtggctgtgacatttacccaggaggagtgggggcagttggacgtgacccagagggccttgtacgtggaggtgatgctggagacctgtgggcttctggtcgcactgggtgacagcacaaaacctgagaccgtagagcctatcccttctcatctggccttgcctgaggaagtctcactccaggaacagctggcacagggagtcccaagatactcctatttggggcaggccatggatcaagatgggccatctgaaatgcaggaatactttttgagaccagggacagacccacagagtgagaaactccatgggaaaatgagccttgaacacgaaggtttggcgacagctgatggtatttgttcaatgatgatacagaaccaagtctcaccagaagatgctctctatggatttgactcatatggaccagttacagattccttgattcatgaaggggaaaattcctataaattcgaggaaatgtttaatgagaattgcttccttgttcagcatgagcagattctccctcgtgtgaagccctatgattgcccagaatgtgggaaagccttcggcaagagcaaacacctccttcagcatcacatcatccatactggggagaagccctataaatgcctggagtgtgggaaagacttcaaccgcaggtcacacctcacacggcaccagcggactcacaatggagataagccctttgtgtgcagtgaatgtggaaggaccttcaatcgcgggtcgcaccttacacggcaccagcgggttcacagtggagagaagccttttgtgtgcaatgaatgtggaaaggcctttacctaccgctccaattttgtcttgcataacaagagccacaatgagaagaaacccttcgcatgcagcgaatgtggaaaaggcttttatgagagtacagccctcattcaacacttcattatccatactggggagaggccctttaagtgccttgagtgtgggaaggccttcaactgcaggtcacacctcaagcagcatgagcggattcacactggtgagaagccctttgtgtgcagtcaatgtggaaaggccttcactcactattccacctatgtcctgcatgaaagagcccacactggagaaaagccttttgagtgcaaagaatgtgggaaagcctttagcattcgaaaagacctcattcgacacttcaacatccacactggagagaagccctatgagtgtttacagtgtggaaaggcttttacccgcatgtcagggctcacaaggcaccagtggattcatactggagagaagccgtatgtatgcatccaatgtgggaaagccttttgtcggaccacaaacctgattcgacactttagcatccacactggagagaagccctatgaatgcgtggagtgcgggaaggccttcaaccgcaggtcacccctcacaaggcaccagcggattcacactgcagagaagtcccacgaacccatccagagtgggaacgtttcttgtgagagcacagatctcattcaacactccatcatccacactgagagtagcccagtgagtgcagtgaatatggaaacgccttcaattgccgctcattcctcctcactcgacatcaacggattcatagtggaagaaaccctaccattgtaacagatgtggaaagactttttacgtacacttcagtcaacatccaagaattcctattagcgaaatagttttttaatataaccactgaagaaaatctgtggtgagaggaaacatcttaccatctggtcattcatactgaagagaaactccataagtatcatctctgtgggaaaacctgttttagatcatcatttgtcatctaaacaattatgttagaaattgacacagccaagagtcttattctacatctgataattcacccatgaaagagacccagtggttactgtgcacttaggaaaaccttcag

SEQ ID NO: 202607 - DNA, 555 bp, Homo sapiens
  Payload ID: 19954
  Gene Name: zinc finger protein 460
  ENST ID: ENST00000599602
  CDS Start-End: 175-555
aatttgagggtcacatacgtccaattacctgccttacatcactgtagctcttaagtttcttaagtcagaaactaacaactggagtctgtgaccttcgaggatgtggctgtgacatttacccaggaggagtgggggcagttggacgtgacccagagggccttgtacgtggaggtgatgctggagacctgtgggcttctggtcgcactgggtgacagcacaaaacctgagaccgtagagcctatcccttctcatctggccttgcctgaggaagtctcactccaggaacagctggcacagggagtcccaagatactcctatttggggcaggccatggatcaagatgggccatctgaaatgcaggaatactttttgagaccagggacagacccacagagtgagaaactccatgggaaaatgagccttgaacacgaaggtttggcgacagctgatggtatttgttcaatgatgatacagaaccaagtctcaccagaagatgctctctatggatttgactcatatggaccagttacagattccttgattcatgaaggggaa

SEQ ID NO: 202608 - DNA, 2361 bp, Homo sapiens
  Payload ID: 19955
  Gene Name: zinc finger protein 461
  ENST ID: ENST00000360357
  CDS Start-End: 233-1855
agctacttccggtaggagcctcgcaggaatggtctccgggtagaggcaggtaaggatgtcccgggccggtggagaaggaagagctgggcgtgtggcttcgcttggaatccgaatcagagcttggaccagagccttccctgagaatgctgaagcaacaccttctttggattgagtttcttccagagggaacgaagaagaggattaaataatacattcaattctaaaataagacatggcccatgagttggtgatgttcagagatgtggctatagatgtctctcaggaggaatgggaatgcctgaacccagcgcagaggaatttgtacaaggaggtgatgttggagaattatagcaacttggtgtcacttggactttctgtttctaagccagccgtaatctcctcattggagcaagggaaggagccctggatggttgtgagggaagagacaggaagatggtgcccagacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaaagaactcattctaaagaactttctgaatgtaaagaatgcacagaaattgttaatacaccatgcctttttaaacaacagacaattcaaaatggtgacaaatgcaatgagtgtaaagaatgttggaaggcctttgttcattgctcacaacttaaacatctaagaattcataatggtgaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgatggcttacaactaaccctacatcagaggattcatactggtgagaaaccctatgagtgtaaggaatgtgggaagacttttagacagtgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctggaaagaaaccttatcaatgcgggaaggcgtttaatcatagattacaacttaacttacatcagactcttcatactggcgagaagccagtcaggtttcctctcctccctccccatcctagtctagcatcatgaaatttgttgatggaaatatacattgtctttgttttatttaaggaaaaagttggtaagccaccagtttcattagtatttatttatttaaataatccttgaaaatcaaatgtttttaagtgagaaagtggataactaaagtgtaaattttggtctcattttaatgctgtttctgagttattgtattaaccattattgagaataaatttttttattgagaataaattttctaaaattacatgtttcactgaaaccagtgaaatatttcactgaaacagtgaaataaaatgaaaacaatttcctcccttccctcaaatctctgagataaccagtatgtgtatttcttcttcctttatgctcaaacaacctgtacacagaaagcattttttgcatgtgtttggaggagcttttacccccatacagacatttgacagcgtcttgtccttttcataataatcatgaatacttttccaggtcagtacgtaaagatgtaacccattctttgtaag

SEQ ID NO: 202609 - DNA, 3326 bp, Homo sapiens
  Payload ID: 19955
  Gene Name: zinc finger protein 461
  ENST ID: ENST00000396893
  CDS Start-End: 211-336
gcaggaatggtctccgggtagaggcaggtaaggatgtcccgggccggtggagaaggaagagctgggcgtgtggcttcgcttggaatccgaatcagagcttggaccagagccttccctgagaatgctgaagcaacaccttctttggattgagtttcttccagagggaacgaagaagaggattaaataatacattcaattctaaaataagacatggcccatgagttggtgatgttcagagatgtggctatagatgtctctcaggaggaatgggaatgcctgaacccagcgcagaggaatttgtacaaggaggactttctgtttctaagccagccgtaatctcctcattggagcaagggaaggagccctggatggttgtgagggaagagacaggaagatggtgcccaggtacatggaaaacttggggatttcacaataatttcttggacaataatgaggctacagacataaatgcagacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaaagaactcattctaaagaactttctgaatgtaaagaatgcacagaaattgttaatacaccatgcctttttaaacaacagacaattcaaaatggtgacaaatgcaatgagtgtaaagaatgttggaaggcctttgttcattgctcacaacttaaacatctaagaattcataatggtgaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgatggcttacaactaaccctacatcagaggattcatactggtgagaaaccctatgagtgtaaggaatgtgggaagacttttagacagtgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctggaaagaaaccttatcaatgcgggaaggcgtttaatcatagattacaacttaacttacatcagactcttcatactggcgagaagccagtcaggtttcctctcctccctccccatcctagtctagcatcatgaaatttgttgatggaaatatacattgtctttgttttatttaaggaaaaagttggtaagccaccagtttcattagtatttatttatttaaataatccttgaaaatcaaatgtttttaagtgagaaagtggataactaaagtgtaaattttggtctcattttaatgctgtttctgagttattgtattaaccattattgagaataaatttttttattgagaataaattttctaaaattacatgtttcactgaaaccagtgaaatatttcactgaaacagtgaaataaaatgaaaacaatttcctcccttccctcaaatctctgagataaccagtatgtgtatttcttcttcctttatgctcaaacaacctgtacacagaaagcattttttgcatgtgtttggaggagcttttacccccatacagacatttgacagcgtcttgtccttttcataataatcatgaatacttttccaggtcagtacgtaaagatgtaacccattctttgtaaggttcagaatatttctagaatggaatgtatgtccgtattttgggccattacctactacagacattgaagttgtttctaatgttcacctagaactctaattttaccttcttttgtttctattgtgcagattcccaacagtgggattaaagagtatctggcgtatatattttgacattacatttattttttaaaatcttctaaattttttgtttaataaaagcacacattataaaaattcaaaaattaccaaaaatgtgaaaattaattctcccctaacatccagttctgtagccactcactttccacagatgcaacaactgctatcagtttccttttattctaacgggaatatttcatgtaaatttcataaattctttggacaaaagtaggttattcataatatgtgatttattacacattctcattattagtccacatttggcctacttcattttttttttttttgagacacacccaggctggagtccagtggtgcaatcttggctcactgcaacctccgccacccaggttaaaaattctcctgcctcagcctcctgagtagctgggactacaggcatgcgcagccactatgcccggccaataagctatatttattcttatttgatgtggatgaaaattatcaaaattggccaggcttggtggctcatgcctgtaatcccagcactttgggaggccgaggcgggcggatcacgaggtcaggagatcgagaccatcctggctaacatggtgaaaccccgtctctactaaaaaaaaaatacaaaaattagctgggcgtggtggtgggtgcctgtagtcccagctactcgggaggctgaggcagaagaatggcgtgaacctgggagatggatcttgcagtaagctgagatcgcgccactgcactccagcgtgggcaacacagtgagactctgtctcaaaaagaaaaaaaaaaaagaaaa

SEQ ID NO: 202610 - DNA, 467 bp, Homo sapiens
  Payload ID: 19955
  Gene Name: zinc finger protein 461
  ENST ID: ENST00000592829
  CDS Start-End: 254-467
cctcgcaggaatggtctccgggtagaggcaggtaaggatgtcccgggccggtggagaaggaagagctgggcgtgtggcttcgcttggaatccgaatcagagcttggaccagagccttccctgagaatgctgaagcaacaccttctttggattgagtttcttccagagggaacgaagaagaggattaaataatacattcaattctaaaataagacatggcccattactattatttgtcattttaggagttggtgatgttcagagatgtggctatagatgtctctcaggaggaatgggaatgcctgaacccagcgcagaggaatttgtacaaggaggtgatgttggagaattatagcaacttggtgtcacttggactttctgtttctaagccagccgtaatctcctcattggagcaagggaaggagccctggatggttgtgagggaagagacaggaagatggtgcccag

SEQ ID NO: 202611 - DNA, 579 bp, Homo sapiens
  Payload ID: 19955
  Gene Name: zinc finger protein 461
  ENST ID: ENST00000590361
  CDS Start-End: 229-369
acttccggtaggagcctcgcaggaatggtctccgggtagaggcaggtaaggatgtcccgggccggtggagaaggaagagctgggcgtgtggcttcgcttggaatccgaatcagagcttggaccagagccttccctgagaatgctgaagcaacaccttctttggattgagtttcttccagagggaacgaagaagaggattaaataatacattcaattctaaaataagacatggcccatgagttggtgatgttcagagatgtggctatagatgtctctcaggaggaatgggaatgcctgaacccagcgcagaggaatttgtacaaggaggtgatgttggagaattatagcaacttggtgtcacttggctagagtgcaatggcgtgatctcggctcaccacaacctctgcctcccagcttcaagcaattctcctgcctcagcctcccgagtagctgtgattacaggactttctgtttctaagccagccgtaatctcctcattggagcaagggaaggagccctggatggttgtgagggaagagacaggaagatggtgcccagacttggcatccagagatgagc

SEQ ID NO: 202612 - DNA, 562 bp, Homo sapiens
  Payload ID: 19955
  Gene Name: zinc finger protein 461
  ENST ID: ENST00000588844
  CDS Start-End: 229-441
acttccggtaggagcctcgcaggaatggtctccgggtagaggcaggtaaggatgtcccgggccggtggagaaggaagagctgggcgtgtggcttcgcttggaatccgaatcagagcttggaccagagccttccctgagaatgctgaagcaacaccttctttggattgagtttcttccagagggaacgaagaagaggattaaataatacattcaattctaaaataagacatggcccatgagttggtgatgttcagagatgtggctatagatgtctctcaggaggaatgggaatgcctgaacccagcgcagaggaatttgtacaaggaggctagagtgcaatggcgtgatctcggctcaccacaacctctgcctcccagcttcaagcaattctcctgcctcagcctcccgagtagctgtgattacaggactttctgtttctaagccagccgtaatctcctcattggagcaagggaaggagccctggatggttgtgagggaagagacaggaagatggtgcccaggtacatggaaaacttggggatttcacaataatttcttggac

SEQ ID NO: 202613 - DNA, 2584 bp, Homo sapiens
  Payload ID: 19955
  Gene Name: zinc finger protein 461
  Uniprot ID: Q8TAF7
  ENST ID: ENST00000588268
  CDS Start-End: 229-1920
acttccggtaggagcctcgcaggaatggtctccgggtagaggcaggtaaggatgtcccgggccggtggagaaggaagagctgggcgtgtggcttcgcttggaatccgaatcagagcttggaccagagccttccctgagaatgctgaagcaacaccttctttggattgagtttcttccagagggaacgaagaagaggattaaataatacattcaattctaaaataagacatggcccatgagttggtgatgttcagagatgtggctatagatgtctctcaggaggaatgggaatgcctgaacccagcgcagaggaatttgtacaaggaggtgatgttggagaattatagcaacttggtgtcacttggactttctgtttctaagccagccgtaatctcctcattggagcaagggaaggagccctggatggttgtgagggaagagacaggaagatggtgcccaggtacatggaaaacttggggatttcacaataatttcttggacaataatgaggctacagacataaatgcagacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaaagaactcattctaaagaactttctgaatgtaaagaatgcacagaaattgttaatacaccatgcctttttaaacaacagacaattcaaaatggtgacaaatgcaatgagtgtaaagaatgttggaaggcctttgttcattgctcacaacttaaacatctaagaattcataatggtgaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgatggcttacaactaaccctacatcagaggattcatactggtgagaaaccctatgagtgtaaggaatgtgggaagacttttagacagtgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctggaaagaaaccttatcaatgcgggaaggcgtttaatcatagattacaacttaacttacatcagactcttcatactggcgagaagccagtcaggtttcctctcctccctccccatcctagtctagcatcatgaaatttgttgatggaaatatacattgtctttgttttatttaaggaaaaagttggtaagccaccagtttcattagtatttatttatttaaataatccttgaaaatcaaatgtttttaagtgagaaagtggataactaaagtgtaaattttggtctcattttaatgctgtttctgagttattgtattaaccattattgagaataaatttttttattgagaataaattttctaaaattacatgtttcactgaaaccagtgaaatatttcactgaaacagtgaaataaaatgaaaacaatttcctcccttccctcaaatctctgagataaccagtatgtgtatttcttcttcctttatgctcaaacaacctgtacacagaaagcattttttgcatgtgtttggaggagcttttacccccatacagacatttgacagcgtcttgtccttttcataataatcatgaatacttttccaggtcagtacgtaaagatgtaacccattctttgtaaggttcagaatatttctagaatggaatgtatgtccgtattttgggccattacctactacagacattgaagttgtttctaatgttcacctagaactctaattttaccttcttttgtttctattgtgcagattcccaacagtgggattaaagagtatctggc

SEQ ID NO: 202614 - DNA, 713 bp, Homo sapiens
  Payload ID: 19955
  Gene Name: zinc finger protein 461
  ENST ID: ENST00000591370
  CDS Start-End: 288-713
aggagcctcgcaggaatggtctccgggtagaggcaggtaaggatgtcccgggccggtggagaaggaagagctgggcgtgtggcttcgcttggaatccgaatcagagcttggaccagagccttccctgagaatgctgaagcaacaccttctttggattgagtttcttccagagggaacgaagaagaggattaaataatacattcaattctaaaataagacatggcccatgactttctgtttctaagccagccgtaatctcctcattggagcaagggaaggagccctggatggttgtgagggaagagacaggaagatggtgcccagacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaaagaactcattctaaagaactttctgaatgtaaagaatgcacagaaattgttaataca

SEQ ID NO: 202615 - DNA, 774 bp, Homo sapiens
  Payload ID: 19955
  Gene Name: zinc finger protein 461
  ENST ID: ENST00000618437
  CDS Start-End: 1-774
gaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgatggcttacaactaaccctacatcagaggattcatactggtgagaaaccctatgagtgtaaggaatgtgggaagacttttagacagtgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctgatgcaacaactgctatcagt

SEQ ID NO: 202616 - DNA, 1692 bp, Homo sapiens
  Payload ID: 19955
  Gene Name: zinc finger protein 461
  ENST ID: ENST00000614133
  CDS Start-End: 1-1692
ttgacccatgagttggtgatgttcagagatgtggctatagatgtctctcaggaggaatgggaatgcctgaacccagcgcagaggaatttgtacaaggaggtgatgttggagaattatagcaacttggtgtcacttggactttctgtttctaagccagccgtaatctcctcattggagcaagggaaggagccctggatggttgtgagggaagagacaggaagatggtgcccaggtacatggaaaacttggggatttcacaataatttcttggacaataatgaggctacagacataaatgcagacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaaagaactcattctaaagaactttctgaatgtaaagaatgcacagaaattgttaatacaccatgcctttttaaacaacagacaattcaaaatggtgacaaatgcaatgagtgtaaagaatgttggaaggcctttgttcattgctcacaacttaaacatctaagaattcataatggtgaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgatggcttacaactaaccctacatcagaggattcatactggtgagaaaccctatgagtgtaaggaatgtgggaagacttttagacagtgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctggaaagaaaccttatcaatgcgggaaggcgtttaatcatagattacaacttaacttacatcagactcttcatactggcgagaagccagtcaggtttcctctcctccctccccatcctagtctagcatcatga

SEQ ID NO: 202617 - DNA, 10414 bp, Homo sapiens
  Payload ID: 19956
  Gene Name: zinc finger protein 462
  Uniprot ID: Q96JM2
  ENST ID: ENST00000277225
  CDS Start-End: 290-7810
ggagagggagggagggagagagagagagagggagagagacggatatctcaggtcatctgcagctgcagcgagtctgaggagccgaggaaggcagggaagatggcgatcctccattgctgagacccggcagaagcacatgagactcccaaacaacttccacaacaataacccgagcaggaagaggagaaagagaaagaggataaggaggcggtggggctggagaacccgaagcacctcccggcgccgggacgcttcttctgttcctaatgtgagaggctagacccagatcatggaggtgcttcagtgtgatggctgtgatttccgagccccgtcttatgaagatctcaaggcacacattcaggatgtccacacggcatttctgcagccaactgatgttgctgaggacaatgtgaatgagctacgatgtgggtccgtgaatgccagtaatcagacagaggtggagttttcttctataaaggatgaatttgccattgcagaagatttatcaggtcaaaatgcaacttcattggggaccggaggttactatggccacagtccaggatattatggtcagcatattgccgctaatcccaaaccaacaaacaagttttttcaatgcaagttctgtgtacgctacttcaggtcaaaaaacctcctcatagaacacactagaaaggtccatggagctcaagctgaagggagttcatcaggaccccctgtcccgggatccttaaattataatatcatgatgcacgagggatttggaaaggtcttctcttgccagttttgcacatacaagtcaccaagaagggcaagaataattaagcatcagaagatgtatcacaaaaacaatttgaaggagaccactgctcccccacctgctcctgctccaatgccagaccctgtggttccgcccgtatcactgcaggacccctgcaaggaactgccagcagaggttgtggagcgcagcatcttagagtctatggtcaagcctttgaccaaatctcgaggcaacttttgttgtgagtggtgcagctaccagaccccccgccgagaacgctggtgtgaccacatgatgaagaaacaccgcagtatggtcaagatcctttccagtctcagacagcaacaagaaggaactaatctacctgatgtgccgaacaagagtgcccccagccccacttccaactccacctatctgaccatgaatgctgcaagccgggagatacccaatactaccgtctccaacttcaggggctccatgggcaactccatcatgagacccaattcttcagcttccaagttttcgcccatgtcttaccctcagatgaagccgaagtcacctcacaattctggtctagttaacttgacagagagatcccgttatggaatgactgacatgaccaattcttctgctgacctggaaactaacagcatgctaaatgactctagttctgatgaagagttaaatgaaatagacagtgagaatggtttaagtgctatggatcaccagacatcaggcctgtctgcagagcagctgatgggctcagatggcaacaaattattggagaccaaggggattccatttagaagattcatgaataggttccagtgccccttttgtcctttcctcaccatgcatcgacgtagcatctctcgtcacatagaaaacatccacttatctggaaagacagctgtctacaaatgtgacgaatgtccgtttacttgcaagagctcgttgaaacttggggctcacaaacagtgtcacacgggtacaacgtcagattgggatgctgtgaattcccagagtgaaagcatttcttcctcactgaatgaaggtgtggtgtcttatgagagctcaagcatcaatggtagaaagtcaggagtcatgttggatcccttgcagcagcaacagccaccgcagccaccaccaccgccgccgccaccaccaccatcacagccacagccactgcagcagccacagccaccacagctgcagccaccacatcaggtgccaccccagccacaaacacagccaccaccaacgcagcagccacagccacccacacaagccgcacctctgcacccatacaaatgcaccatgtgtaattactccaccacaactctgaaagggctaagagtccatcagcagcataaacattcattctgtgacaacttgccaaaattcgaggggcagccctcaagcctaccattggaaaatgagacagacagccacccctcttccagcaacactgtgaagaaaagtcagacctcaattcttgggttgtcctccaagaacaattttgtagctaaagcctctaggaagctcgccaatgactttcctctagatttgtcacccgtgaagaagagaaccaggattgacgagatagcaagcaaccttcagagcaaaattaaccaaaccaaacagcaggaagatgcagtgatcaatgttgaggatgatgaagaggaagaggaagacaacgaagtcgagatagaggttgagttggacagggaggaagaaccgacagaacccatcatagaggttcccacttccttttctgcccaacagatatgggtaagagataccagtgagccccagaaagagcccaacttcagaaacatcacccacgattacaatgccaccaatggggctgagattgagctcaccctttctgaagatgaagaggattattatggctcctcaacaaacttgaaagatcaccaagtttccaatactgctctgctgaatacccaaactcccatctatgggactgagcacaatagtgaaaacacagactttggtgactctggaaggctttactattgtaaacactgtgactttaacaacaaatctgcccggagtgttagcacccactaccaacgaatgcacccatacattaaattcagctttaggtacatcttggaccccaatgatcacagtgcagtgtacaggtgcctggaatgctacatcgattacaccaacttcgaagatctccagcagcattatggcgagcaccacccagaagccatgaatgtactcaactttgatcactcggacctgatctaccggtgtcggttttgttcatacacgagcccgaatgttagaagcctgatgccacattaccaaagaatgcatcccacggtgaagatcaacaacgcgatgatattttcaagctatgtcgtggagcagcaggaagggctgaatacagaatcccagaccctgagggagattctgaattcggctcccaagaacatggcgacttccacacctgtggctcgtggtggtggtttgccagctacgttcaacaaaaacactcctaagacctttactcctgaatgtgaaaatcagaaggaccctttggtcaacactgttgttgtttatgattgtgatgtttgttcgtttgcaagccccaacatgcattctgtcttggttcattatcagaagaaacaccccgaagaaaaggcttcctactttaggatccagaaaactatgcgaatggtgtctgtggacaggggctctgccctttctcaattatcatttgaggtgggtgctccaatgtctcccaaaatgtccaacatgggttccccaccccccccacaacccccgccaccagacctcagtactgagctttactactgcaaacactgttcctacagcaatcggtcagttgtgggagtgcttgtccactaccagaaaagacacccagaaataaaggttactgccaaatatatcagacaggctcctcccacagctgcaatgatgagaggggtcgaagggccccaaggctccccccggccacccgcccccatacaacagctgaaccgaagcagctctgagagagatggccctcctgtggagaatgagatgttcttttgccagcactgtgattatgggaaccggacggtcaaaggggtactcattcattatcagaagaagcaccgagacttcaaggccaatgcagatgtgatccggcagcatacggccaccattcgaagcctctgcgaccgaaatcagaagaagcctgccagctgcgtgcttgtctccccctctaatctggagcgggacaaaacgaaactccgagcactcaaatgtaggcagtgctcatatacctccccctacttctatgcactgaggaagcatatcaagaaagaccaccccgccctgaaagccacagtcacgtccatcatgcgatgggcatttctagatggcttgatagaagctggctaccactgcgagtggtgcatctactcccatacggagcccaacggtttgctcctgcattaccaacggaggcatccagaacactatgttgattacacctacatggctactaaactgtgggctgggccagacccatcccctccctctctcacaatgccagccgaagccaaaacctacagatgcagggactgtgttttcgaagctgtttccatctgggacatcactaatcactaccaagcattccacccctgggccatgaatggtgatgagtcagtgctactggacatcatcaaggagaaagatgctgtggagaagcccattctttcatccgaagagttggcaggccctgtgaattgtgaaaacagtatacccacccctttcccggagcaggaagctgaatgtccagaggatgcaagactgtcccctgagaaaagcctgcagctagcttcagccaaccccgccatatcctccaccccataccagtgcacggtatgccaatctgagtataacaacttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcattctgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacagaaaacaaaaaaaaaaaaactgctttgcataaaacagtcacctgtttcctagtacctcaaacttaaccaagggaactctctgcatttgtcagtactacctgtcgtcgttgtggttaaatgtagagagaactgctgggcaagatggtgaatggagaaaaaaaaagagttttaaagaaaggaacacaaattgtgcttaaaatccccatgtgggttttatttcttaaaatactgtgatttttttaattattttagtaaaaaacaaaacaaaaaaaagaaacagactttaattattagataactgtttgtgaattgtcatcctttattccaggtaagctgtttattagtgttcaactataatttagaatttggtagattcatgtgagctaattttaaggtgattgtggagttttgtttgccacatgtttattttctatcaatttgagtgttacaaacacagcacaattcagtttttcatatgaattgtttttcgtgtgtgtgttgttattgttgttttaatttcggggcaagggagatttagttttttgtgaataggaatgtttttattttaaacatggaaataacaaagaagttaactttcttttttttttttttttttttttttaatttaactaaagaaccaaactttcggcacagctatgcagcttgtgggccagacgaggaggtcctcctcacccttttgttgcctgtcaaattcacgcattatccgtctcataaataatttctgttaggattggctggcttttgtgtgtgattttaaaatctgtgttttgtttctgctggcattgtgttttgttgggggttttcatttatttaggggacgaggggatgtactagaatcccatccctttcgtgagagtggacaagaaataacatatcctacaaggagcctggagaactactttctttctttctttttttttttttttttttttttttaaatctagctgccagctgctctgtcccccatatcagctttttcaggagggagcagcttagactaaatctaagcctacatttataatatgttctgattgtgaacaaagggtttcgttccaaaaaatagaaaagaacttttcttgaagcctaggttttagaagcccgtgtgtgtgtgtgcttggatgtgtgtgtgcgtgtatgagtgtgtgtgtgcatgtgtgcacgtgtgaatcctttggttttcatgtttttttttttttttttttacttggaagggttgtgggagggtgggagggaagaaagggaaggggaattgctgagatgacagtgtcccacacagcttcaaataaaatccatggaaagatgttgcatttgtggaataagtgcttacttgaaaagcatgttcttcttttattttcttactgttaagaatttttatttgtaggatgtttgttttaatttaatttttttaagggatgggggccatcatgtggaaaccagaaaatggggaaagtgtgaactatccagacaaagattcattttgtgtctatatttgtttttaattggcctcatttcaaatgtattaaacagttccatacctggattgggtgtttgtaatggttaccaaaaaacaaacaaaaaaagaaagaaaaaggaaaaaaaaaaagaaaataattgtgacatgcttttatcactactttatttttcaaataacatgtaaatattgtaatccattggattttgttttgctaacctgttaataaaaatatgggaccattatccttttaacaaggctagaatgtcatttttttctttttcaaacatatacctgatattttgtggccgcacattttggatgcattattataattctgttgactgtaatgacatagaatttacaacattttttgttgttgtttaatttatacagaggacatttttttcagagcttgagagaagaaaataaatagcaaaatgataacctattgactccagtaatcagtgtttcccaatacttcataagagatagggagaccctgagtccttgaagccaagggtttaaaaacaaaacaaaaacaaaaaaaaccacaagtaggttattcaagttgtttgcaacatacattttgtaatgaaatgtgagaaattaataaagaatttttttcacatgtg

SEQ ID NO: 202618 - DNA, 4828 bp, Homo sapiens
  Payload ID: 19956
  Gene Name: zinc finger protein 462
  ENST ID: ENST00000374686
  CDS Start-End: 1-4350
cactgttcctacagcaatcggtcagttgtgggagtgcttgtccactaccagaaaagacacccagaaataaaggttactgccaaatatatcagacaggctcctcccacagctgcaatgatgagaggggtcgaagggccccaaggctccccccggccacccgcccccatacaacagctgaaccgaagcagctctgagagagatggccctcctgtggagaatgagatgttcttttgccagcactgtgattatgggaaccggacggtcaaaggggtactcattcattatcagaagaagcaccgagacttcaaggccaatgcagatgtgatccggcagcatacggccaccattcgaagcctctgcgaccgaaatcagaagaagcctgccagctgcgtgcttgtctccccctctaatctggagcgggacaaaacgaaactccgagcactcaaatgtaggcagtgctcatatacctccccctacttctatgcactgaggaagcatatcaagaaagaccaccccgccctgaaagccacagtcacgtccatcatgcgatgggcatttctagatggcttgatagaagctggctaccactgcgagtggtgcatctactcccatacggagcccaacggtttgctcctgcattaccaacggaggcatccagaacactatgttgattacacctacatggctactaaactgtgggctgggccagacccatcccctccctctctcacaatgccagccgaagccaaaacctacagatgcagggactgtgttttcgaagctgtttccatctgggacatcactaatcactaccaagcattccacccctgggccatgaatggtgatgagtcagtgctactggacatcatcaaggagaaagatgctgtggagaagcccattctttcatccgaagagttggcaggccctgtgaattgtgaaaacagtatacccacccctttcccggagcaggaagctgaatgtccagaggatgcaagactgtcccctgagaaaagcctgcagctagcttcagccaaccccgccatatcctccaccccataccagtgcacggtatgccaatctgagtataacaacttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcattctgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaaggaggcggatgaccctgcccacttgttcctggatggattggaagcagccaaagacgccagtggcgccctggtgggccgggtggatggtgaacactgcttgcttgatggaatgttggaggatgaaacccggccggggggataccattgcagtcaatgtgacagagtcctgatgtccatgcaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacag

SEQ ID NO: 202619 - DNA, 4691 bp, Homo sapiens
  Payload ID: 19956
  Gene Name: zinc finger protein 462
  Uniprot ID: Q96JM2
  ENST ID: ENST00000441147
  CDS Start-End: 1-4239
atgatgagaggggtcgaagggccccaaggctccccccggccacccgcccccatacaacagctgaaccgaagcagctctgagagagatggccctcctgtggagaatgagatgttcttttgccagcactgtgattatgggaaccggacggtcaaaggggtactcattcattatcagaagaagcaccgagacttcaaggccaatgcagatgtgatccggcagcatacggccaccattcgaagcctctgcgaccgaaatcagaagaagcctgccagctgcgtgcttgtctccccctctaatctggagcgggacaaaacgaaactccgagcactcaaatgtaggcagtgctcatatacctccccctacttctatgcactgaggaagcatatcaagaaagaccaccccgccctgaaagccacagtcacgtccatcatgcgatgggcatttctagatggcttgatagaagctggctaccactgcgagtggtgcatctactcccatacggagcccaacggtttgctcctgcattaccaacggaggcatccagaacactatgttgattacacctacatggctactaaactgtgggctgggccagacccatcccctccctctctcacaatgccagccgaagccaaaacctacagatgcagggactgtgttttcgaagctgtttccatctgggacatcactaatcactaccaagcattccacccctgggccatgaatggtgatgagtcagtgctactggacatcatcaaggagaaagatgctgtggagaagcccattctttcatccgaagagttggcaggccctgtgaattgtgaaaacagtatacccacccctttcccggagcaggaagctgaatgtccagaggatgcaagactgtcccctgagaaaagcctgcagctagcttcagccaaccccgccatatcctccaccccataccagtgcacggtatgccaatctgagtataacaacttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcattctgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaagcaggaggcggatgaccctgcccacttgttcctggatggattggaagcagccaaagacgccagtggcgccctggtgggccgggtggatggtgaacactgcttgcttgatggaatgttggaggatgaaacccggccggggggataccattgcagtcaatgtgacagagtcctgatgtccatgcaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttggg

SEQ ID NO: 202620 - DNA, 1233 bp, Homo sapiens
  Payload ID: 19956
  Gene Name: zinc finger protein 462
  ENST ID: ENST00000427098
  CDS Start-End: 1-625
ggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgaggtaacctttctaacttggttttcttggatgcagcggggggcaggcagcagagatggccttctagggatgctctctcagagtggcagtagcacctgtgccttgttcctcaccttatcttcaggcaagaaaccacagtgataaccacagtgacagccaaaagggcaaaaacaccttcctgctgggagtatttcctccacctggagggaggcaaaggtgatggattctgcagtgaacatttccgtagggcttcccagcatgggggatttgtacattctgacaattctgccacccacagccttgcgtagactgcatagaaggaatgaacaagaaacaaaatgggtgggtgaaagcaaatgtgaaatgtggagagctctatggctgtgagagattctttcaagaagaccaaaatgatttccaaagcagaacatggaacttcccttgaaatggttgaagggagagagaattctttaaaataatgtatattatacattctaataatagtctctattatatattctaataataattagaaaatccatgggctttggatttaaattctggttttagagcccactgtgtttaacctctccatccattaaaagagatgattgtacctatgagataatgggtaaagtgtccagtggtttttcataatggatgcataatgactgctcaataaatgttggttcctgctgat

SEQ ID NO: 202621 - DNA, 551 bp, Homo sapiens
  Payload ID: 19956
  Gene Name: zinc finger protein 462
  ENST ID: ENST00000472574
  CDS Start-End: 221-551
gagtctgaggagccgaggaaggcagggaagatggcgatcctccattgctgagacccggcagaagcacatgagactcccaaacaacttccacaacaataacccgagcaggaagaggagaaagagaaagaggataaggaggcggtggggctggagaacccgaagcacctcccggcgccgggacgcttcttctgttcctaatgtgagaggctagacccagatcatggaggtgcttcagtgtgatggctgtgatttccgagccccgtcttatgaagatctcaaggcacacattcaggatgtccacacggcatttctgcagccaactgatgttgctgaggacaatgtgaatgagctacgatgtgggtccgtgaatgccagtaatcagacagaggtggagttttcttctataaaggatgaatttgccattgcagaagatttatcaggtcaaaatgcaacttcattggggaccggaggttactatggccacagtccaggatattatgccttttggtcacttagaagaggtgccaaagatcaaggagaggaaagtggtg

SEQ ID NO: 202622 - DNA, 2553 bp, Homo sapiens
  Payload ID: 19957
  Gene Name: zinc finger protein 467
  Uniprot ID: Q7Z7K2
  ENST ID: ENST00000302017
  CDS Start-End: 415-2202
gagctcccacttccacacctactccaggctcggagccttaggaccatcacctgcccacctaagcccacggtgctccctcctgggaccccactcctgaaaccccctgcccctgcctcccccagcccggtgcgccggggctctccgcccgctccctcggtccctcctcccttgcaggcgccgtttcccggcttcgactccccgcgcgtctatccctctcctccccgcgaagtttcggggctgtcagtctgtcagtctttcaggccgtcagcacccgagctgcaggcggcgagcgccattgtgagcagagccggcggggcaggaggcccgggcgcctgggtccccgcggcgcgggcggagcggccggccagccaggttctgtggcctgatccccaggaggagctactctgggttaccatgagagagaccttggaggccctcagctccctgggattctctgtgggacagccagagatggccccccaaagtgagcccagggaaggatcccataatgcccaggagcagatgtcctcttctagggaagagagagcactgggggtgtgctcagggcacgaggcccctacaccggaggaaggtgcccacacagaacaagccgaggctccctgcagaggccaggcgtgctcagcacagaaggctcagcctgtgggtacctgcccaggagaggagtggatgattcggaaggtgaaggtggaggacgaagatcaggaggcagaagaggaggtcgaatggccccagcatctatcgttacttcccagcccctttcccgcgcctgacctggggcatctggctgccgcgtacaaactggagccaggggccccgggggcactgagtgggctcgcgctgtctgggtggggtccgatgccggagaagccctacggctgcggggagtgtgagcggcgcttccgggaccagctgacgttgcgactgcaccagcggctgcaccggggcgagggcccctgcgcctgcccggactgcggccgcagcttcacgcagcgcgcccacatgctactgcatcagcgcagccaccgcggcgagcggcctttcccgtgctccgagtgcgacaagcgcttcagcaagaaggcccatctgacccgccacctgcgcacgcacacgggcgagcggccctacccgtgcgcggagtgcggcaagcgcttcagccagaagatccacctgggctcgcaccaaaagacccacaccggcgagcggcccttcccctgcacggaatgcgagaagcgctttcgcaagaagacgcacttgattcggcaccagcgcatccatacgggcgagaggccctaccagtgcgcacagtgcgcacgcagcttcacgcacaagcagcacttggtgcggcaccaaagggtgcaccagacggccggcccggccaggccctctcccgactcgtccgcttctcctcattccactgccccgtccccgaccccatcctttcccgggccaaagcctttcgcgtgctccgactgcggcttgagcttcggctggaaaaagaacctcgccacgcaccagtgtctgcaccgcagcgagggtcgcccctttgggtgcgatgagtgcgcactgggcgccaccgtggatgcccccgccgccaagcccctggccagcgcgcctggcggaccgggctgcggcccaggatccgatcccgtggtgccccagcgcgccccctcgggcgagcggtccttcttctgcccggactgcgggcgcggcttctcccatgggcagcacctggcgcggcacccgcgcgtgcacacgggcgaacggcccttcgcctgcacgcagtgtgaccgccgcttcggctcgcggcctaatctggtcgcccactccagggcccacagcggcgccaggcctttcgcctgcgctcagtgcggccgccgcttcagccgcaagtcgcacctgggccgccaccaggcggtgcacactggcagccgcccccacgcctgcgccgtctgcgcccgcagcttcagctccaaaaccaacctagtccgccaccaggcgatccacacaggctcccgccccttctcctgcccgcagtgcggaaagagcttcagccgcaagacccacctggtgcggcaccagctcattcacggcgaagccgcccacgcggccccggacgccgcccttgcggccccagcctggtccgctccccccgaggtggcgccgcccccgctcttcttctgagcctagttctcacgaggaccctttcttgcccacagtttcgagaggcccgtgccatgagaccgcctggggtgagcaaggcgacctgggctgctgcccgaaggtttggccgccgcgggacacctgtttccttcccgcagtgtctgcgtccgcacagcatacccagctcggacctcctaggacagagactcagcgaacccttgctgggaaccgctgagctgaagttcttggaaggctcccacccaggtgccccgttggaaagcagatatttcccggacccagcgcggcctcaaccagggcaggaaagagtggttatttatgtacttaaagtttcattaaagttaaaatcggaaa

SEQ ID NO: 202623 - DNA, 913 bp, Homo sapiens
  Payload ID: 19957
  Gene Name: zinc finger protein 467
  ENST ID: ENST00000484747
  CDS Start-End: 155-595
gccgtcagcacccgagctgcaggcggcgagcgccattgtgagcagagccggcggggcaggaggcccgggcgcctgggtccccgcggcgcgggcggagcggccggccagccaggttctgtggcctgatccccaggaggagctactctgggttaccatgagagagaccttggaggccctcagctccctgggattctctgtgggacagccagagatggccccccaaagtgagcccagggaaggatcccataatgcccaggagcagatgtcctcttctagggaagagagagcactgggggtgtgctcagggcacgaggcccctacaccggaggaaggtgcccacacagaacaagccgaggctccctgcagaggccaggcgtgctcagcacagaaggctcagcctgtgggtacctgcccagtttcgagaggcccgtgccatgagaccgcctggggtgagcaaggcgacctgggctgctgcccgaaggtttggccgccgcgggacacctgtttccttcccgcagtgtctgcgtccgcacagcatacccagctcggacctcctaggacagagactcagcgaacccttgctgggaaccgctgagctgaagttcttggaaggctcccacccaggtgccccgttggaaagcagatatttcccggacccagcgcggcctcaaccagggcaggaaagagtggttatttatgtacttaaagtttcattaaagttaaaatcggaaagttctggggctgctaaatgaattgggggagggaacacctgactctccttagccactgtcccacctccatccacacacagaccacccccctccacttccccttctgtcctgggtgagttacatttagccagctgctgttaattggttctcccaaataaaaatgtaatatatttattcactaa

SEQ ID NO: 202624 - DNA, 4027 bp, Homo sapiens
  Payload ID: 19958
  Gene Name: zinc finger protein 468
  ENST ID: ENST00000243639
  CDS Start-End: 152-535
ggtttctgtcctgcgcgcgcagattcgcgcagaccaggaagtggatcccgtggaatgacggtcacgccgcggcgggcggattgacttctaaagactgttggtacgtgagaaagaaacccagaagaggaagaggaaagcaaaggagtcagggatggctcttcctcagggtctattgacattcagggacgtggccatagaattctctcaggaggagtggaaatgcctggaccctgctcagaggactttatacagggacgtgatgctggagaattataggaacctcgtctccctggagttttggtctgtcatcccggctaaagtacagtggtgtcatctccgctcactgcaacctccacttcccaggttcaagcaattctcctgcctcagccttccaagtacctgggactacagatatctcttccaaatgcatgttgaagacgttgtcgtcaacagggcaaggcaatacagaagtgatccacacagggacattgcacagacaagcaagtcatcacattggagaattttgtttccatgaaattgagaaagacattcatggcttcgagtttcagtggaaagaagatgaaacaaatggccatgcagcacccatgacagaaatcaaagagttggctggtagtacaggccaacatgatcaaaggcatgctggaaacaagcgtattaaagatcagcttggatcaagctttcatttgcatctgcctgaaccgcacatatttcagtctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaatgggaagtacacatgagagaaaaatcttttgaatgtatacagagcttcaaatcctttaattgcagctcactcttaaaaaaacatcagataattcacttagaagagaaacaatgtaaatgtgatgtatgtggcaaggtctttaatcagaagcgataccttgcctgccatcgtagatgtcacactggtgagaaaccttacaagtgtaatgagtgtggcaagacctttggtcataattcatccctcttcattcacaaagcgcttcatactggagagaaaccttatgaatgtgaagaatgtgacaaagttttcagtcgcaaatcacaccttgaaagacataagaggattcatactggagagaaaccatacaaatgtaaggtttgtgatgaggctttcgcatataattcatatctggcaaaacatactatacttcacactggagagaaaccttacacatgtaatgaatgtggcaaagtttttaatcgactatcaacccttgcacgccatcatagacttcatactggagagaaaccttacaaatgtgaagagtgtgacaaagttttcagtcgcaaatcacaccttgaaagacataggaggattcatagtggagagaaaccttacaaatgtgaagaatgttgcaaagttttcagtcgcaaatcaaacctggaaagacacaggaggattcatactggagagaaaccatacaaatgtaaggtttgtgacaaggctttccagagggattcacacctggcacaacatcagagagttcatactggagagaaaccttacaagtgtaatgagtgtggcaagaccttcggtcagacatcatcgcttataatccatcgtaggcttcatactggagagaaaccttacaagtgtaatgagtgtggcaagaccttcagtcagatgtcatcccttgtataccatcataggcttcatagtggagagaagccttaatagtgtaatgagtgtggcaagaccttccatcacaattcaaccctgtaagtcataaggcaattcatactggagagaaaccttacaagcataatgaatgtggcaaggtttttaatcaaaaagcaacctttgcacatcaccatagacttcatactggagagaaaccttacaaatgggaggaatgtgacaaaagttttcagttgtaaatcaaaccttaaaacacataagaaaattcacattgaagagaaaccatacagaggtaaggtttgtgacaaggtttttgcatataatgcatatctggcaaaacatactagaattcacactggagagaaactcattataagtgtaatgagtgtggcaagaccgttggtcaaaattcacaccttgtaattaaaaggtcaaaattcacaccttgtaattcatagtggagagaaaccttacaagcacaatgaatgtgacatggtttttaatcaacaatcacaccttgcaagtcatcatagacttcatactgcatagaaatcttacaaacgtgaacaatgtgacaaagttttcattcacaaatccagcttcaaatacataggagaattcacactggagaaaagccatagaaatgtaaggtttgtgacaaggctttcgggaatgattcacacgtggcaccccatactagaattcacactggagagaaaccttacaagtgcaatgagtgtggcaaaccctttagtgggcagtcaccacttattcaccatcaagcaatccatggtatagggaaacttgactaatgtaatgattgtcacaaagttttcagtaatgctacaaccattgcacatcattggagaatccacagtgaagagatcttacaagtgtaataaatgtggcaaatttttcagacatcgttcatgccttgcatttcactggtgaactcatgctggagagaaaccttataaatgtcatgattgaggcaaggtcttcagtcaagcttcatcctatgcaaaacataggaggattcatacaggagagaaacctcacaagtgtgatgattgtggcaaagcgtttacttcacattcacacctcattagacatcagagaatccatgctggacagaaatcttacaaatgtcatcagtgtggaagggtcttcagtccaaggtcactccttgcagaccatcagacaattccttttggagacagttgtttcaaatgcagtgagtatagcaaaccatcaagcattaattgacattagagtcaaatcagccttgacctgagtttgttgatttaacattgatttcaagcattaattgccattaaactgtttatgttaagaggattgcactgggggccatggctcatgcctgtaattccagcactttgagaggcaaagacaggtaggtcactggagctcacgagtttgagaacagcctagccaacagatgggagctacttttcccagcctttattttctttttcttgttttttttttgagatggagtcttgctctgtcgcccaggttggagtgcagtggcacgatctcagctcactgcaacctcctcctcccaggttcaagcaattctcctgcctcagtctcccaagtagctgacactacagttgtgtgccaccacacctgggtaattttttgtgtttttagtagagactgggtttcaccgtgttagccagaatggtctctatcttctgactttatgatccacccgactccacctcccaaagtgctgagattacaggagtgagccactgtgcctggcctgttttttgtttctttaacaaaaagttatagagacttctatgagtattgtaccgaatctaaatcacaattgagtatataatcattgagcgatattcatttttccaatcagtatgggatttatatctatttatacatgtttttaatcattttgatcaatgtttatagatttcaaggtacaaacctcactttttatgtttattcctaaatatttcttactttaagttctttagcaaatggaattggtttttaattttcttttaaaattatttattgttaatgtatggaaattcaactaatttttggtgctgttattctattctgcaaataaactgaatgtgtttgttagttccagttgcattttggctgactctttgtgattttctttacagaaggtcatgtcatctacaaacaaataaaatttgacttctttcttt

SEQ ID NO: 202625 - DNA, 384 bp, Homo sapiens
  Payload ID: 19958
  Gene Name: zinc finger protein 468
  ENST ID: ENST00000396409
  CDS Start-End: 1-384
atgtcacttgttcagggtctattgacattcagggacgtggccatagaattctctcaggaggagtggaaatgcctggaccctgctcagaggactttatacagggacgtgatgctggagaattataggaacctcgtctccctggagttttggtctgtcatcccggctaaagtacagtggtgtcatctccgctcactgcaacctccacttcccaggttcaagcaattctcctgcctcagccttccaagtacctgggactacagatatctcttccaaatgcatgttgaagacgttgtcgtcaacagggcaaggcaatacagaagtgatccacacagggacattgcacagacaagcaagtcatcacattggagaattttgtttccatga

SEQ ID NO: 202626 - DNA, 578 bp, Homo sapiens
  Payload ID: 19958
  Gene Name: zinc finger protein 468
  ENST ID: ENST00000601980
  CDS Start-End: 237-374
agaccaggaagtggatcccgtggaatgacggtcacgccgcggcgggcggattgacttctaaagactgttggtacgtgagaaagaaacccagaagaggaagaggaaagcaaaggagtcagggatggctcttcctcagtccctctcatctcgcttaggttccgtctctcgtgacccagtgtcatgaacttgggaagaggctgcactgggcaggtcctgggaagggctcacaccccgacatggatggacacggggtgagggtcctgtggtgtcagtgctcttgggcagcagggattgttcaggggccacatctggatgcactgtcagctcactgtggaccaggattggagcagctgccaatgggagtcacgtattaatatgcacgaagtacgtgggtctattgacattcagggacgtggccatagaattctctcaggaggagtggaaatgcctggaccctgctcagaggactttatacagggacgtgatgctggagaattataggaacctcgtctccctggagttttggtctgtcatcccggctaaagtacagtggtgtcatctccgctcactgcaacctc

SEQ ID NO: 202627 - DNA, 533 bp, Homo sapiens
  Payload ID: 19958
  Gene Name: zinc finger protein 468
  ENST ID: ENST00000597924
  CDS Start-End: 122-533
agaccaggaagtggatcccgtggaatgacggtcacgccgcggcgggcggattgacttctaaagactgttggtacgtgagaaagaaacccagaagaggaagaggaaagcaaaggagtcagggatggctcttcctcagggtctattgacattcagggacgtggccatagaattctctcaggaggagtggaaatgcctggaccctgctcagaggactttatacagggacgtgatgctggagaattataggaacctcgtctccctggtacgtagaagtgaagtgtgttgtacagatatttgggcagaggttattgttgcagatatctcttccaaatgcatgttgaagacgttgtcgtcaacagggcaaggcaatacagaagtgatccacacagggacattgcacagacaagcaagtcatcacattggagaattttgtttccatgaaattgagaaagacattcatggcttcgagtttcagtggaaagaagatgaaacaaatggccatgcagcacccatgacagaaatcaaagagttgg

SEQ ID NO: 202628 - DNA, 4407 bp, Homo sapiens
  Payload ID: 19958
  Gene Name: zinc finger protein 468
  Uniprot ID: Q5VIY5
  ENST ID: ENST00000595646
  CDS Start-End: 122-1690
agaccaggaagtggatcccgtggaatgacggtcacgccgcggcgggcggattgacttctaaagactgttggtacgtgagaaagaaacccagaagaggaagaggaaagcaaaggagtcagggatggctcttcctcagggtctattgacattcagggacgtggccatagaattctctcaggaggagtggaaatgcctggaccctgctcagaggactttatacagggacgtgatgctggagaattataggaacctcgtctccctggatatctcttccaaatgcatgttgaagacgttgtcgtcaacagggcaaggcaatacagaagtgatccacacagggacattgcacagacaagcaagtcatcacattggagaattttgtttccatgaaattgagaaagacattcatggcttcgagtttcagtggaaagaagatgaaacaaatggccatgcagcacccatgacagaaatcaaagagttggctggtagtacaggccaacatgatcaaaggcatgctggaaacaagcgtattaaagatcagcttggatcaagctttcatttgcatctgcctgaaccgcacatatttcagtctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaatgggaagtacacatgagagaaaaatcttttgaatgtatacagagcttcaaatcctttaattgcagctcactcttaaaaaaacatcagataattcacttagaagagaaacaatgtaaatgtgatgtatgtggcaaggtctttaatcagaagcgataccttgcctgccatcgtagatgtcacactggtgagaaaccttacaagtgtaatgagtgtggcaagacctttggtcataattcatccctcttcattcacaaagcgcttcatactggagagaaaccttatgaatgtgaagaatgtgacaaagttttcagtcgcaaatcacaccttgaaagacataagaggattcatactggagagaaaccatacaaatgtaaggtttgtgatgaggctttcgcatataattcatatctggcaaaacatactatacttcacactggagagaaaccttacacatgtaatgaatgtggcaaagtttttaatcgactatcaacccttgcacgccatcatagacttcatactggagagaaaccttacaaatgtgaagagtgtgacaaagttttcagtcgcaaatcacaccttgaaagacataggaggattcatagtggagagaaaccttacaaatgtgaagaatgttgcaaagttttcagtcgcaaatcaaacctggaaagacacaggaggattcatactggagagaaaccatacaaatgtaaggtttgtgacaaggctttccagagggattcacacctggcacaacatcagagagttcatactggagagaaaccttacaagtgtaatgagtgtggcaagaccttcggtcagacatcatcgcttataatccatcgtaggcttcatactggagagaaaccttacaagtgtaatgagtgtggcaagaccttcagtcagatgtcatcccttgtataccatcataggcttcatagtggagagaagccttaatagtgtaatgagtgtggcaagaccttccatcacaattcaaccctgtaagtcataaggcaattcatactggagagaaaccttacaagcataatgaatgtggcaaggtttttaatcaaaaagcaacctttgcacatcaccatagacttcatactggagagaaaccttacaaatgggaggaatgtgacaaaagttttcagttgtaaatcaaaccttaaaacacataagaaaattcacattgaagagaaaccatacagaggtaaggtttgtgacaaggtttttgcatataatgcatatctggcaaaacatactagaattcacactggagagaaactcattataagtgtaatgagtgtggcaagaccgttggtcaaaattcacaccttgtaattaaaaggtcaaaattcacaccttgtaattcatagtggagagaaaccttacaagcacaatgaatgtgacatggtttttaatcaacaatcacaccttgcaagtcatcatagacttcatactgcatagaaatcttacaaacgtgaacaatgtgacaaagttttcattcacaaatccagcttcaaatacataggagaattcacactggagaaaagccatagaaatgtaaggtttgtgacaaggctttcgggaatgattcacacgtggcaccccatactagaattcacactggagagaaaccttacaagtgcaatgagtgtggcaaaccctttagtgggcagtcaccacttattcaccatcaagcaatccatggtatagggaaacttgactaatgtaatgattgtcacaaagttttcagtaatgctacaaccattgcacatcattggagaatccacagtgaagagatcttacaagtgtaataaatgtggcaaatttttcagacatcgttcatgccttgcatttcactggtgaactcatgctggagagaaaccttataaatgtcatgattgaggcaaggtcttcagtcaagcttcatcctatgcaaaacataggaggattcatacaggagagaaacctcacaagtgtgatgattgtggcaaagcgtttacttcacattcacacctcattagacatcagagaatccatgctggacagaaatcttacaaatgtcatcagtgtggaagggtcttcagtccaaggtcactccttgcagaccatcagacaattccttttggagacagttgtttcaaatgcagtgagtatagcaaaccatcaagcattaattgacattagagtcaaatcagccttgacctgagtttgttgatttaacattgatttcaagcattaattgccattaaactgtttatgttaagaggattgcactgggggccatggctcatgcctgtaattccagcactttgagaggcaaagacaggtaggtcactggagctcacgagtttgagaacagcctagccaacagatgggagctacttttcccagcctttattttctttttcttgttttttttttgagatggagtcttgctctgtcgcccaggttggagtgcagtggcacgatctcagctcactgcaacctcctcctcccaggttcaagcaattctcctgcctcagtctcccaagtagctgacactacagttgtgtgccaccacacctgggtaattttttgtgtttttagtagagactgggtttcaccgtgttagccagaatggtctctatcttctgactttatgatccacccgactccacctcccaaagtgctgagattacaggagtgagccactgtgcctggcctgttttttgtttctttaacaaaaagttatagagacttctatgagtattgtaccgaatctaaatcacaattgagtatataatcattgagcgatattcatttttccaatcagtatgggatttatatctatttatacatgtttttaatcattttgatcaatgtttatagatttcaaggtacaaacctcactttttatgtttattcctaaatatttcttactttaagttctttagcaaatggaattggtttttaattttcttttaaaattatttattgttaatgtatggaaattcaactaatttttggtgctgttattctattctgcaaataaactgaatgtgtttgttagttccagttgcattttggctgactctttgtgattttctttacagaaggtcatgtcatctacaaacaaataaaatttgacttctttctttctgatttggatgagtttgatttcttttgctatttcattgttctggctaggacagccagtattgattgaatagaaggggtgagagcattcttgcatcatgtgagatcctacaggaaaagcattccgttttccctgattggttatttctgctgtggtcatttcatggatggtctttgtattgctgaggtaaattttcttctgtatctattttgtgtgggatttctatgatgacttgatgttgacttttgtgaaatgctttttctccatgtattgagatgatgtggttttcatctttcattgtgttcaagtggtatatcacattgatttgcttgactatgttgaaccatccttgcatcccagaaataagtggcacttgcatatctacaatccttttaatatcctcttgaatacagttcgctagtacaaggggtcttcaagaagttcatgaaaaaaatacatattatgtgaaaattgcacatgatgtcacattttctgcaccaaaataaactggcacaaatctgttataaca

SEQ ID NO: 202629 - DNA, 646 bp, Homo sapiens
  Payload ID: 19958
  Gene Name: zinc finger protein 468
  ENST ID: ENST00000601847
  CDS Start-End: 511-646
atagctgggattacagacatgtgtcactgtgcccagcctatcttttactgtggacgttgtcatcttttaagatatcagttgtgctctgtctcatctagataatgaatgtcacttggtgtgtctataaaagtttcaaacatttttataacaggaaccctacattgattttttatttgtttatttctgttatttttcacaaacataagaaatttatactgagagtatgtcttgataatactcaaaaagtgtaataaaatacatctggggagacatcatgtagtgagaaatcccttatttggatttgtcagaacattctctacagttaaatccatgctttcccctctctcctcctctcattttttgtaaagataagatctcctcccataaccatttggttaaaatgtgttttcatttcagggtctattgacattcagggacgtggccatagaattctctcaggaggagtggaaatgcctggaccctgctcagaggactttatacagggacgtgatgctggagaattataggaacctcgtctccctggagttttggtctgtcatcccggctaaagtacagtggtgtcatctccgctcactgcaacctccacttcccaggttcaagcaattctcctgcctcagccttccaa

SEQ ID NO: 202630 - DNA, 571 bp, Homo sapiens
  Payload ID: 19958
  Gene Name: zinc finger protein 468
  ENST ID: ENST00000602144
  CDS Start-End: 122-355
agaccaggaagtggatcccgtggaatgacggtcacgccgcggcgggcggattgacttctaaagactgttggtacgtgagaaagaaacccagaagaggaagaggaaagcaaaggagtcagggatggctcttcctcaggttccgtctctcgtgacccagtgtcatgaacttgggaagaggctgcactgggcaggtcctgggaagggctcacaccccgacatggatggacacggggtgagggtcctgtggtgtcagtgctcttgggcagcagggattgttcaggggccacatctggatgcactgtcagctcactgtggaccaggattggagcagctgccaatgggagtcacgtattaatatgcacgaagtacgtgggtctattgacattcagggacgtggccatagaattctctcaggaggagtggaaatgcctggaccctgctcagaggactttatacagggacgtgatgctggagaattataggaacctcgtctccctggagttttggtctgtcatcccggctaaagtacagtggtgtcatctccgctcactgcaacctccacttcccaggt

SEQ ID NO: 202631 - DNA, 13203 bp, Homo sapiens
  Payload ID: 19959
  Gene Name: zinc finger protein 469
  Uniprot ID: Q96JG9
  ENST ID: ENST00000437464
  CDS Start-End: 1-11778
atgcctggggagcgcccccgaggagcgccgccccccaccatgactggagacctgcagccccgccaagttgccagcagcccggggcacccctcccagccgccactggaggacaacaccccagctaccaggaccaccaagggtgccagggaggctggcggccaggcccaggccatggagctccccgaggcccagccaaggcaggccagggacggggagctcaagcccccatccctgagaggccaggccccgagcagcacccctgggaagaggggcagcccccagaccccaccggggagaagccccttgcaggctccctcaaggctggcgggcagggcagagggcagccccccacagcgctacattctgggcatcgccagctcgaggaccaagcccaccctggacgagacaccagagaacccacagctggaggctgcccagctccctgaggtggacaccccccagggccctgggactggagctccactcaggccgggcctcccaaggactgaggcccaacccgccgccgaagagcttggcttccacaggtgcttccaggagccaccctccagctttacctccaccaactatacctcaccaagcgccacccccaggcccccagccccggggcccccccagagcaggggcaccagccccctccagcccggttcctatcccgaataccaggccagtggggccgactcctggcctcccgctgctgagaatagcttcccaggtgctaatttcggggttccccccgccgagccggaacctattcccaaaggcagcaggcccggcggcagccccaggggagtttccttccagttccccttcccggcactgcatggggccagcacaaaacccttccctgcggatgtggctgggcacgcattcaccaatgggccactggtgtttgccttccatcagccccagggagcgtggccggaggaggccgtgggcacgggccctgcctacccgctgcccacccagcctgcgccctcacccctgccctgctaccagggccagccaggtggcctgaaccgccacagcgacctcagtggtgccctctcttcccctggagctgctcactcggccccgagacccttctctgacagtttacacaagagcctgaccaaaatccttcccgaaagaccaccttcagcccaggatgggctggggagcacgagagggccccctagctccctaccccagaggcactttccagggcaggcgtacagagccagtggggtggacaccagcccggggcctccggacaccgagctggccgccccagggcccccacccgccaggctgccccagctgtgggaccccacagcagccccttaccccacacctcctgggggccccctggctgccaccaggagtatgttctttaacggccagcccagcccaggccagcggctctgcctcccccagagtgcccccctgccttggccccaagtgctcccgaccgcccggccaagtccccacggaatggagatgctgagccggctgcctttccccgcggggggccccgagtggcaggggggcagccaaggagccctgggcactgctggcaagacaccgggacccagagagaagctgccagccgtgagaagcagccagggcggctccccagcactgttcacctacaacggaatgacagaccctggggctcagcccctgttcttcggggtggcccagccccaggtttcaccccacgggacacccagcctgcccccaccgagggtagtgggagcctcccccagcgagtccccactgccgtcaccggccaccaacacggccggcagcacctgctcttccctgtcgccgatgtccagcagcccagccaaccccagctcagaggaaagccagctccccggccccctcgggccctcggccttcttccacccacccactcacccccaggagacgggcagccccttcccgtccccggagcccccccactccctccccacccactaccagccagagccagccaaggccttcccttttcccgcagatgggctgggagccgagggtgccttccagtgcctggaggagaccccattcccccacgagggccccgaggtgggtcggggagggctgcagggcttcccccgtgcgccgcctccgtaccccacacaccacttctccctcagcagcgccagcctggaccagctggacgtgctgctgacctgcaggcagtgtgaccgcaactacagcagcctggcggccttcctggcccaccggcagttctgtggcctgctcctggccagggccaaggatggccaccagcggtctccaggcccccctgggctcccctcgccccccgctgcccccagagtccctgccgacgcacacgcgggcttgctcagccacgcgaagaccttcctgttagctggggacgcccaggccgagggcaaagacgaccccctgaggacaggcttcctgcccagcctggccgccacccccttcccgctccctgcctcggacctggacatggaggatgacgccaagctggacagcctcatcacagaggcgctcaacggcatggagtaccagtcggacaacccggagatcgacagcagcttcatcgacgtcttcgcggacgaggagccttccggccccagaggtcccagctccggacacccccttaagagcaaggcgggggtgactccagagagcaaagctccgcccccgctcccagcagccacgccggacccccaaaccccccgccctggggacaggggctgcccagcccgaggcaggcccaaaacgcgttccctgggtctggcccccaccgaggcggatgcgcccagccagggcaggcagcagaggagggggaagcagttgaagctgttccggaaggatctggactcgggcggcgcagcagaggggtcggggtcgggcggcggcggcagagcctccggcctgaggccccggaggaacgacggtctcggggagcggcccccaccccgtccccggcgccctagaacgcaggcccccgggagccgcgcagaccccgcgccccgggtcccgagagccgccgccctccccgaggagacccgcagctcccggcgccgccggctgccccccaggaaggaccccaggaagaggaaggctcggggcggcgcctggggcaaggagctcattctgaagatcgtgcagcagaagaacaggctccgcgagtacgacttcgcctcggagtccgaggaggacgagcagcctccgccgcggggccccggcttcagaggccggcggggccgaggcgagaagaggaaggaagtggagctgacccagggtcccagagaggatgagccacagaaaccccggaaggcggcgaggcaggaagccggcggggacggagcccccgcgaaccccgaggagccgggcgggtctcgcccgggccccggcaggagccctcaggcccgtggcccgtctcgaagcctggagacgggagcggccgccagggagggaggccccaagtgtgctgatcgcccctcagtggcccccaaggatcccctgcaggtccccaccaacaccgagacctcagaggaaacccgcccgtcgctggactttccccaggaggccaaggagcctgaaactgccgaagagtcagccccggacagcacagaattcacagaggctttgcgttctcctccagccgcctgtgcgggagaaatgggagcaagccccggtctcctgataccagagcagccgccgcccagcagacatgacaccggcacccccaagccgtcgggaagcctcgccaacacggcgccccacggaagctcgccaacgccaggtgtgggcagcctgctgggtggtcctgggggcacacaggccccagtctcccacaacagcaaggacccccctgcccgccagcctggagaatttctggcacccgtggctaacccctcaagtaccgcctgccccaaacccagtgttctgtcttcaaagatctccagttttggctgtgaccctgctggttttaacagagaccccttgggggttccagttgccaaaaaggggcctcagccctacagcagcccccacagtgagttgttcctcggacccaaagacctggctggctgtttcctggaagaactgcaccccaagccctcagccagggatgccccgccggccagcagctcctgcctttgccaggacggcgaggatgccggttccctcgagccacagctgccaaggagcccacctggcaccgctgagacggagccaggcagggctgcatcgccaccgaccttggagtcctcatccctcttcccagacctgccggtggacagattcgacccacccctctatggcagcctgtctgcgaacagggactccggtctgccgttcgcatgtgccgaccctccccagaagacggtgccgtcagatccaccgtacccctcttttttgctgcttgaggaagtatccccgatgctgcctagccattttcctgatctctcggggggaaaggtgctcagtaagacgtgtccccctgaacggacagtggttcccggcgccgccccatctttgcctgggaaggggagtggatgtagcgttgctcttatgagtcacctgtccgaggatgaactggagatccagaaattggtcaccgaattagaaagtcagctgcaaaggagcaaagacacacgtggggccccgagagagcttgcagaagctgagtcggtgggcagggtggagctcggcacaggcacagagccaccctcccaacggcgcacctgccaggccaccgtgccccacgaggacacgttctcggcagctgacctcacgcgcgttggagaatccactgcacatcgggagggtgcggaatcggctgtggccaccgtggaagcggttcaggggaggcctggggggacgtggccctgcccagcctccttccatccgggacatgcagcccttctcccctgtgcccaggaagacctggtttctggggctcctttcagccccaggggagccaacttccattttcagccagtgcagaaagccggagcctccaagactggactttgccaggcagaaggagacagcaggcccccccaagatgtctgcctgcctgagcccagcaagcagcctggcccacagctggatgccgggagtttagcaaagtgcagccccgaccaggaactttcatttcctaagaataaggaggccgccagctcacaagaaagtgaagactccctgcggctgcttccctgtgaacagagaggagggttcctcccagagcccggcacagcagaccagccccaccgaggggcccctgctccagaagcttttggcagccctgctgtccatctggcccctgacttggcatttcagggtgacggggctccacctctggatgccacctggccttttggtgccagtcccagccatgctgcccagggacattctgcaggcagagcaggtgggcacctccaccccacggcagggaggcctggctttgagggtaatgagtttgcaccggcgggggcctcctcactgactgccccccggggcagggaggcttggttggtccctgtgccaagtcccgcctgtgtatccaacacccaccctagcaggaggtcccaggacccagctttgagcccccccatacgtcagctccagctcccagggcctggagtggctaagagtaaagatggcatcctgggcttgcaggagctgacacctgctgcccagagccctccacgagtgaacccctcaggtctggaagggggcactgtggaaggagggaaggtggcctgtggccccgcccagggctccccagggggtgtgcaggtgacaactctccctgcagtggccggacatcagctggggctggaggcagatggacattggggcttgcttggccaagccgagaaaacccagggccaaggcacagccaaccagcttcagccagagaacggggtgagcccagggggcacggacaaccacgcctcagtcaatgccagtcccaaaacagcgctgaccggccccaccgagggtgcagtcctgctagagaaatgcaagggaagcagggcagccatgagccttcaggaggaggccgagcccaccccaagccccccgtcccctaatagggagtccctggcgctggccttgacagcagcccacagccgaagtggatctgagggccggactccagagagggcgtccagccccggcctgaacaagccactgctggccacaggggatagcccagcaccctctgtcggggacctggccgcctgcgccccctcacccacttcagccgcccacatgccctgcagccttgggcccctgccccgtgaagacccacttacctcgccttccagggcccaaggtgggctgggggggcagctgccagcatctccgtcctgcagggaccctcccggcccccagcagctgctggcctgttctcctgcctgggcacctctggaagaggcagatggcgtccaagccacgacagatactggggctgaggattccccggtggctcccccgtctttgacaacaagcccctgcgatcccaaggaagccctggctggttgccttctccagggggagggcagccccctggaagacccttcctcctggcctcctggctccgtcagtgctgtaacctgcactcacagtggggacacccccaaagacagcactttaagaattccagaggattccagaaaagagaagctgtgggagtctcctggccgagccacctctcctcctctggcaggggccgtctcccccagcgtggccgtcagggctactggcctgtccagcactcccaccggagatgaggcacaggcaggcaggggactcccagggccagacccccagagcaggggagccccgccccacaccaaccctgacaggatgcccaggggccactcctcgtattctccaagcaatactgcccgcctcggccacagggagggccaggctgtcacagctgtgcccactgagcctcccacgctacagggtgcagggccggactcccccgcctgcctggaaggtgagatggggaccagcagcaaggagccggaggacccagggacccctgagaccgggcgctctggtgctaccaagatgcccagggtcacctgcccttccacaggactgggcttgggaagaaccacagccccaagcagcacagccagtgacttccagtctgactccccccaaagccacagaaatgcctcccaccagactccccagggggaccccctcggcccccaagacctcaaacagaggtcccgtggctataaaaagaagcctgcatctacagagaacggccagtggaagggccaagctccacatgggcctgtgacctgtgaggtctgcgcagcctccttccgctccgggccgggcctgagccggcacaaggccaggaagcaccggccacacccgggagcccccgcggagccgagcccagcggccttgcctgctcagcagcctctagagcccctagcccaaaagtgccagccgcccaggaagaaaagccacagggtgtctgggaaggagagaccaaatcactcacggggagaccccagccacgtcacccagccaccgcctgcccagggctcaaaggaggttctcagagcaccggggtccccacacagccagcagctgcaccctccaagccctactgagcatgaggtagatgtgaagactccggcctccaagcccagaccagaccaggccagggaagatgagctgcatcccaaacaggcagaaaaaagagaaggccggaggtggcgccgagagcccaccgtggactctcctagccactcagaggggaagtcaaataagaaaaggggaaagctgagagggagaaggctccgggaggagagcattcttccagtctctgctgatgtgatttcagatgggcgcggctccagaccatcccctgcaatggccagttacgcagcctctccgagccactgcctctctgtggaaggagggcctgaggctgacggggagcagccgcctcgcttggccactctgggacctggggtgatggagggtgcagcggagactgaccaggaggctctgtgtgcaggggagactggggcccagaagccacctggagatcggatgctgtgtccagggaggatggatggtgcagctctgggggaacagccaactgggcagaagggagcctcggcaagggggttctggggaccaagagagaccaaggcgttgggtgtgtgcaaagagtctgggagcgagcctgcggaggacagcagcagggcccacagccgatcagaggaaggtgtctgggaggagaacacgccccccttgggccccctgggttttcccgagacttccagctctccggcggacagcaccaccagcagctgcctccagggcctcccggacaacccagacacccagggtggagtccaggggcctgaaggccccactcctgatgcctctggctccagtgccaaggatcctccaagcttgtttgatgatgaggtctctttctcccagctcttccctccaggcggtcgcttgactagaaagaggaacccgcatgtctacgggaagcgctgtgagaagccggtgctcccgctgccaacccagcccagctttgaggagggcggtgaccccacgctgggcccagcccgcctgcccacggacctcagcgactccagctccctctgcctctgccatgaggacccgtgggaggacgaggatcccgcaggtctgcccgagtccttcctcctggatgggttcctcaatagcagggtgcctggcattgacccctgggcccccggcctcagcctgtgggccctggagcccagcagggaagctggtgcagagaagctgccctcccactgccccgaggacgatcggccggaggccattcctgagctgcacatggtcccagcggcttggcgaggcctggagatgccggcccctgccgatgactcctcctcttctctcggagatgtgagccccgagccccccagcctggagagagaacgctgtgacggtgggcttcccgggaacacccacctgctgccgctccgtgccacggactttgaggtgctcagcaccaagtttgagatgcaagacctgtgctttctgggaccctttgaagaccccgtgggtctccccggccccagcttcttagacttcgagggcacggcgagctcacaggggccacagagccgaaggacagaggaggctgcaggggcagggagggcccaaggcagaggccggccggccaagggcaggcgggcctcctacaagtgcaaagtgtgcttccagcgcttccgcagcctgggcgagctggacctgcacaagctggcccacacgcccgcgccgccgcccacctgctacatgtgcgtggagcgcaggtttggctcgcgggagctgctgcgggggcacctgcaggagaggcacgcgcagagcaaggccgggccctgggcgtgcggcatgtgcctgaaggaggtggccgacgtctggatgtacaacgagcacctgcgtgagcacgcggtccgcttcgcccgcagggggcaggcgcggaggtccttgggggacctgcccggaggcctggagggcagcagcgctgtcgcccaccttctgaacagcatcacggaacccgcgcccaaacaccacaggggcaagcgctccgccggcaaggccgccgggagcccgggagacccgtgggggcaagagggagaagccaagaaagacagcccgggcgagagggcgaaaccccgggcacgcagcacccccagcaacccagacggggccgcgaccccagacagcgcctctgccaccgccctggctgacgccggcagcccgggcccccccaggacgacccccagcccgtcccccgacccctgggccggcggggagcccctcctgcaagccaccccggtgcacgaggcctgcaaggacccctcccgcgactgccaccactgcgggaagcgcttccccaagcccttcaagctgcagcgccacctggcggtgcacagcccgcagcgcgtctacctgtgcccccggtgcccccgggtctaccccgagcacggggagctgctggcacacctgggcggggcgcacgggctgctggagcggccggagctgcagcacacgccgctgtatgcctgcgagctctgcgccacggttatgcgcatcatcaagaagtccttcgcctgcagctcctgcaactacaccttcgccaagaaggagcagttcgaccgccacatgaacaagcacctcaggggggggcggcagcccttcgcgttccgcggcgtgcggaggccgggagcgccgggacagaaggcccgggccctcgagggcacactgcccagcaaacggcgcagggtggccatgcccggcagtgcccctgggcccggcgaggacaggcctcctccccggggaagcagccccatcctgagtgagggctctctcccggccctgctccacctgtgttcggaggtggctcccagcaccaccaagggatggcccgagaccctagagaggcctgtagaccccgtgacccacccgatcagaggttgtgagctgccatccaaccaccaggagtgtcccccgccgtctctgtctcccttcccagctgccttggctgatggcagaggagactgcgcgctggacggagccctggagaggccagagaacgaggcttccccaggcagccccgggcctcttctccagcaagctctccctctgggggcatctctgccgcggccgggagccagaggccaagatgcggagggaaagagggctcctctcgtgttctcagggaaacgcagggccccgggtgcccgtggcaggtgtgcccctgaccatttccaggaagaccacctacttcagaaagagaaggaggtgtcctcaagccacatggtgtctgagggggggccccgaggcgccttccacaagggcagcgccaccaagcctgcgggctgccagagctcatcaaaggacaggtcggcagcatccacccccagcaaagcactcaagttcccagtgcacccaaggaaggcggtggggagcctggcacccggggagctggcccgtggcacagagaatgggatgaagcccgccacccccaaagccaaacccggccccagctcccagggcagtggaagccctcgccccggcaccaagacaggaggtggcagccagccccagccagccagcgggcagctccagagcgagacagccaccaccccagccaagcccagcttccccagccggagccctgcaccagagaggctccccgctcgagcccaagccaagagctgcaccaaggggccaagggaagctggtgagcaggggccccacgggagcctaggtcccaaggagaagggagagagcagtacgaagaggaaaaagggccaggtcccagggccagccaggagtgaaagtgtggggagcttcgggagagccccctcagcccctgacaagcccccccggacccctcggaagcaggcaactcccagccgcgtgctcccgaccaagcccaagcccaacagccagaacaaacccaggccgccaccatcagagcagcggaaggcagagccgggccacacacagaggaaggacagactgggcaaggccttcccccaggggagacccctgctcaggccccccaagaggggcacagctgtccacggtgctgaacctgccgagccacacacccaccggacggccgaggcccagagtgacctcctcagccagctcttcgggcagagactaactggcttcaaaatccctttaaagaaagatgcttccgagtaatttctaggagcaagagcctgggaccggagctgggcgttcctgtctcggcctgcctccttggccagctccggctccctgagatggtccactctgtggccacttgacttcttgtgcaactgctcaggccttgatgtcagagctgaggtggtgatgctttgaacagggcccaggtgggcagcattccctttcttgctggaaggctgggggtgaaagacggggccactgcagcccttttgagaccacacagctgttttcttggtaccaagtacttgaagagacagcagcccatcccctcagcccacacccctgcgccctgtgggcaccgacaccacagaagccaatgtttggagatttgcacaacctcccgttcccccacatggagaagggaagtaagttgaggcagccgtgggatggtggtaggttccctcttagtcttgctgctgttgctggaattccaaagtgaccttagaaaccacgtgggggaaggcagtgctcactacttagaagggttgcttctgagccgcctggtcccccaagagcacaacaggcctcctccctctgaccacagggtcatgcctcctccctctgaccacagggtcatgccagcctccatttgctctgcgggagaaaagcccatctctagcacaccttgaccccaggaaccgggttcccgtatggaactgggaagaaaccgcccctgtgccagctcccgcgggccctcctcgttccctcccagcctccatggccgccctctagagcctccctgctgtacggagctctgggctccgcctatttgcaatgttactctgaagtttctggtgctatttttgtgttgtaatgtgaatacaggcttccttgatttttttttttaatgggggtattgggtgggacagacggggtcagggaggccccaccatggcttgtcgagggcacgggcacctgcatggcggcgctctccctgcctcccctgccgggctgcaagcctgaggtctgtgctgccagacggggatgctcagggctggggctgcagagccgctgccctggccagggcaccctcatgcaccgacccaacccaggcctgggacgcacgtgtcctctcacagcgtcgtgcctgtgaaggtgggtcaaagggtgagagggcttccttctcacccttctctccataagtatcttgaagatccatggtttgttttgctctattgtttagtttttacttgggtgcaatgtgtacgtcaaaagtttttattttgatatttgaaagagaccaaatcaggcccagaccgcctctctggaaggtgttgtaggccattcaaaacgcctccggagtgtcgcaaaccaagtgcggaggggccctgaggttgtactgtaaacatcatagtgacttgtcttttcaaatatattcccactattttcgcagaaaacctc

SEQ ID NO: 202632 - DNA, 13279 bp, Homo sapiens
  Payload ID: 19959
  Gene Name: zinc finger protein 469
  ENST ID: ENST00000565624
  CDS Start-End: 1-11862
atgcctggggagcgcccccgaggagcgccgccccccaccatgactggagacctgcagccccgccaagttgccagcagcccggggcacccctcccagccgccactggaggacaacaccccagctaccaggaccaccaagggtgccagggaggctggcggccaggcccaggccatggagctccccgaggcccagccaaggcaggccagggacggggagctcaagcccccatccctgagaggccaggccccgagcagcacccctgggaagaggggcagcccccagaccccaccggggagaagccccttgcaggctccctcaaggctggcgggcagggcagagggcagccccccacagcgctacattctgggcatcgccagctcgaggaccaagcccaccctggacgagacaccagagaacccacagctggaggctgcccagctccctgaggtggacaccccccagggccctgggactggagctccactcaggccgggcctcccaaggactgaggcccaacccgccgccgaagagcttggcttccacaggtgcttccaggagccaccctccagctttacctccaccaactatacctcaccaagcgccacccccaggcccccagccccggggcccccccagagcaggggcaccagccccctccagcccggttcctatcccgaataccaggccagtggggccgactcctggcctcccgctgctgagaatagcttcccaggtgctaatttcggggttccccccgccgagccggaacctattcccaaaggcagcaggcccggcggcagccccaggggagtttccttccagttccccttcccggcactgcatggggccagcacaaaacccttccctgcggatgtggctgggcacgcattcaccaatgggccactggtgtttgccttccatcagccccagggagcgtggccggaggaggccgtgggcacgggccctgcctacccgctgcccacccagcctgcgccctcacccctgccctgctaccagggccagccaggtggcctgaaccgccacagcgacctcagtggtgccctctcttcccctggagctgctcactcggccccgagacccttctctgacagtttacacaagagcctgaccaaaatccttcccgaaagaccaccttcagcccaggatgggctggggagcacgagagggccccctagctccctaccccagaggcactttccagggcaggcgtacagagccagtggggtggacaccagcccggggcctccggacaccgagctggccgccccagggcccccacccgccaggctgccccagctgtgggaccccacagcagccccttaccccacacctcctgggggccccctggctgccaccaggagtatgttctttaacggccagcccagcccaggccagcggctctgcctcccccagagtgcccccctgccttggccccaagtgctcccgaccgcccggccaagtccccacggaatggagatgctgagccggctgcctttccccgcggggggccccgagtggcaggggggcagccaaggagccctgggcactgctggcaagacaccgggacccagagagaagctgccagccgtgagaagcagccagggcggctccccagcactgttcacctacaacggaatgacagaccctggggctcagcccctgttcttcggggtggcccagccccaggtttcaccccacgggacacccagcctgcccccaccgagggtagtgggagcctcccccagcgagtccccactgccgtcaccggccaccaacacggccggcagcacctgctcttccctgtcgccgatgtccagcagcccagccaaccccagctcagaggaaagccagctccccggccccctcgggccctcggccttcttccacccacccactcacccccaggagacgggcagccccttcccgtccccggagcccccccactccctccccacccactaccagccagagccagccaaggccttcccttttcccgcagatgggctgggagccgagggtgccttccagtgcctggaggagaccccattcccccacgagggccccgaggtgggtcggggagggctgcagggcttcccccgtgcgccgcctccgtaccccacacaccacttctccctcagcagcgccagcctggaccagctggacgtgctgctgacctgcaggcagtgtgaccgcaactacagcagcctggcggccttcctggcccaccggcagttctgtggcctgctcctggccagggccaaggatggccaccagcggtctccaggcccccctgggctcccctcgccccccgctgcccccagagtccctgccgacgcacacgcgggcttgctcagccacgcgaagaccttcctgttagctggggacgcccaggccgagggcaaagacgaccccctgaggacaggcttcctgcccagcctggccgccacccccttcccgctccctgcctcggacctggacatggaggatgacgccaagctggacagcctcatcacagaggcgctcaacggcatggagtaccagtcggacaacccggagatcgacagcagcttcatcgacgtcttcgcggacgaggagccttccggccccagaggtcccagctccggacacccccttaagagcaaggcgggggtgactccagagagcaaagctccgcccccgctcccagcagccacgccggacccccaaaccccccgccctggggacaggggctgcccagcccgaggcaggcccaaaacgcgttccctgggtctggcccccaccgaggcggatgcgcccagccagggcaggcagcagaggagggggaagcagttgaagctgttccggaaggatctggactcgggcggcgcagcagaggggtcggggtcgggcggcggcggcagagcctccggcctgaggccccggaggaacgacggtctcggggagcggcccccaccccgtccccggcgccctagaacgcaggcccccgggagccgcgcagaccccgcgccccgggtcccgagagccgccgccctccccgaggagacccgcagctcccggcgccgccggctgccccccaggaaggaccccaggaagaggaaggctcggggcggcgcctggggcaaggagctcattctgaagatcgtgcagcagaagaacaggcgccaccggcggctggggcggcgggcgggcaggtgcggctccctggcggcggggaggccccggcccggagctgaggaccgcaggctccgcgagtacgacttcgcctcggagtccgaggaggacgagcagcctccgccgcggggccccggcttcagaggccggcggggccgaggcgagaagaggaaggaagtggagctgacccagggtcccagagaggatgagccacagaaaccccggaaggcggcgaggcaggaagccggcggggacggagcccccgcgaaccccgaggagccgggcgggtctcgcccgggccccggcaggagccctcaggcccgtggcccgtctcgaagcctggagacgggagcggccgccagggagggaggccccaagtgtgctgatcgcccctcagtggcccccaaggatcccctgcaggtccccaccaacaccgagacctcagaggaaacccgcccgtcgctggactttccccaggaggccaaggagcctgaaactgccgaagagtcagccccggacagcacagaattcacagaggctttgcgttctcctccagccgcctgtgcgggagaaatgggagcaagccccggtctcctgataccagagcagccgccgcccagcagacatgacaccggcacccccaagccgtcgggaagcctcgccaacacggcgccccacggaagctcgccaacgccaggtgtgggcagcctgctgggtggtcctgggggcacacaggccccagtctcccacaacagcaaggacccccctgcccgccagcctggagaatttctggcacccgtggctaacccctcaagtaccgcctgccccaaacccagtgttctgtcttcaaagatctccagttttggctgtgaccctgctggttttaacagagaccccttgggggttccagttgccaaaaaggggcctcagccctacagcagcccccacagtgagttgttcctcggacccaaagacctggctggctgtttcctggaagaactgcaccccaagccctcagccagggatgccccgccggccagcagctcctgcctttgccaggacggcgaggatgccggttccctcgagccacagctgccaaggagcccacctggcaccgctgagacggagccaggcagggctgcatcgccaccgaccttggagtcctcatccctcttcccagacctgccggtggacagattcgacccacccctctatggcagcctgtctgcgaacagggactccggtctgccgttcgcatgtgccgaccctccccagaagacggtgccgtcagatccaccgtacccctcttttttgctgcttgaggaagtatccccgatgctgcctagccattttcctgatctctcggggggaaaggtgctcagtaagacgtgtccccctgaacggacagtggttcccggcgccgccccatctttgcctgggaaggggagtggatgtagcgttgctcttatgagtcacctgtccgaggatgaactggagatccagaaattggtcaccgaattagaaagtcagctgcaaaggagcaaagacacacgtggggccccgagagagcttgcagaagctgagtcggtgggcagggtggagctcggcacaggcacagagccaccctcccaacggcgcacctgccaggccaccgtgccccacgaggacacgttctcggcagctgacctcacgcgcgttggagaatccactgcacatcgggagggtgcggaatcggctgtggccaccgtggaagcggttcaggggaggcctggggggacgtggccctgcccagcctccttccatccgggacatgcagcccttctcccctgtgcccaggaagacctggtttctggggctcctttcagccccaggggagccaacttccattttcagccagtgcagaaagccggagcctccaagactggactttgccaggcagaaggagacagcaggcccccccaagatgtctgcctgcctgagcccagcaagcagcctggcccacagctggatgccgggagtttagcaaagtgcagccccgaccaggaactttcatttcctaagaataaggaggccgccagctcacaagaaagtgaagactccctgcggctgcttccctgtgaacagagaggagggttcctcccagagcccggcacagcagaccagccccaccgaggggcccctgctccagaagcttttggcagccctgctgtccatctggcccctgacttggcatttcagggtgacggggctccacctctggatgccacctggccttttggtgccagtcccagccatgctgcccagggacattctgcaggcagagcaggtgggcacctccaccccacggcagggaggcctggctttgagggtaatgagtttgcaccggcgggggcctcctcactgactgccccccggggcagggaggcttggttggtccctgtgccaagtcccgcctgtgtatccaacacccaccctagcaggaggtcccaggacccagctttgagcccccccatacgtcagctccagctcccagggcctggagtggctaagagtaaagatggcatcctgggcttgcaggagctgacacctgctgcccagagccctccacgagtgaacccctcaggtctggaagggggcactgtggaaggagggaaggtggcctgtggccccgcccagggctccccagggggtgtgcaggtgacaactctccctgcagtggccggacatcagctggggctggaggcagatggacattggggcttgcttggccaagccgagaaaacccagggccaaggcacagccaaccagcttcagccagagaacggggtgagcccagggggcacggacaaccacgcctcagtcaatgccagtcccaaaacagcgctgaccggccccaccgagggtgcagtcctgctagagaaatgcaagggaagcagggcagccatgagccttcaggaggaggccgagcccaccccaagccccccgtcccctaatagggagtccctggcgctggccttgacagcagcccacagccgaagtggatctgagggccggactccagagagggcgtccagccccggcctgaacaagccactgctggccacaggggatagcccagcaccctctgtcggggacctggccgcctgcgccccctcacccacttcagccgcccacatgccctgcagccttgggcccctgccccgtgaagacccacttacctcgccttccagggcccaaggtgggctgggggggcagctgccagcatctccgtcctgcagggaccctcccggcccccagcagctgctggcctgttctcctgcctgggcacctctggaagaggcagatggcgtccaagccacgacagatactggggctgaggattccccggtggctcccccgtctttgacaacaagcccctgcgatcccaaggaagccctggctggttgccttctccagggggagggcagccccctggaagacccttcctcctggcctcctggctccgtcagtgctgtaacctgcactcacagtggggacacccccaaagacagcactttaagaattccagaggattccagaaaagagaagctgtgggagtctcctggccgagccacctctcctcctctggcaggggccgtctcccccagcgtggccgtcagggctactggcctgtccagcactcccaccggagatgaggcacaggcaggcaggggactcccagggccagacccccagagcaggggagccccgccccacaccaaccctgacaggatgcccaggggccactcctcgtattctccaagcaatactgcccgcctcggccacagggagggccaggctgtcacagctgtgcccactgagcctcccacgctacagggtgcagggccggactcccccgcctgcctggaaggtgagatggggaccagcagcaaggagccggaggacccagggacccctgagaccgggcgctctggtgctaccaagatgcccagggtcacctgcccttccacaggactgggcttgggaagaaccacagccccaagcagcacagccagtgacttccagtctgactccccccaaagccacagaaatgcctcccaccagactccccagggggaccccctcggcccccaagacctcaaacagaggtcccgtggctataaaaagaagcctgcatctacagagaacggccagtggaagggccaagctccacatgggcctgtgacctgtgaggtctgcgcagcctccttccgctccgggccgggcctgagccggcacaaggccaggaagcaccggccacacccgggagcccccgcggagccgagcccagcggccttgcctgctcagcagcctctagagcccctagcccaaaagtgccagccgcccaggaagaaaagccacagggtgtctgggaaggagagaccaaatcactcacggggagaccccagccacgtcacccagccaccgcctgcccagggctcaaaggaggttctcagagcaccggggtccccacacagccagcagctgcaccctccaagccctactgagcatgaggtagatgtgaagactccggcctccaagcccagaccagaccaggccagggaagatgagctgcatcccaaacaggcagaaaaaagagaaggccggaggtggcgccgagagcccaccgtggactctcctagccactcagaggggaagtcaaataagaaaaggggaaagctgagagggagaaggctccgggaggagagcattcttccagtctctgctgatgtgatttcagatgggcgcggctccagaccatcccctgcaatggccagttacgcagcctctccgagccactgcctctctgtggaaggagggcctgaggctgacggggagcagccgcctcgcttggccactctgggacctggggtgatggagggtgcagcggagactgaccaggaggctctgtgtgcaggggagactggggcccagaagccacctggagatcggatgctgtgtccagggaggatggatggtgcagctctgggggaacagccaactgggcagaagggagcctcggcaagggggttctggggaccaagagagaccaaggcgttgggtgtgtgcaaagagtctgggagcgagcctgcggaggacagcagcagggcccacagccgatcagaggaaggtgtctgggaggagaacacgccccccttgggccccctgggttttcccgagacttccagctctccggcggacagcaccaccagcagctgcctccagggcctcccggacaacccagacacccagggtggagtccaggggcctgaaggccccactcctgatgcctctggctccagtgccaaggatcctccaagcttgtttgatgatgaggtctctttctcccagctcttccctccaggcggtcgcttgactagaaagaggaacccgcatgtctacgggaagcgctgtgagaagccggtgctcccgctgccaacccagcccagctttgaggagggcggtgaccccacgctgggcccagcccgcctgcccacggacctcagcgactccagctccctctgcctctgccatgaggacccgtgggaggacgaggatcccgcaggtctgcccgagtccttcctcctggatgggttcctcaatagcagggtgcctggcattgacccctgggcccccggcctcagcctgtgggccctggagcccagcagggaagctggtgcagagaagctgccctcccactgccccgaggacgatcggccggaggccattcctgagctgcacatggtcccagcggcttggcgaggcctggagatgccggcccctgccgatgactcctcctcttctctcggagatgtgagccccgagccccccagcctggagagagaacgctgtgacggtgggcttcccgggaacacccacctgctgccgctccgtgccacggactttgaggtgctcagcaccaagtttgagatgcaagacctgtgctttctgggaccctttgaagaccccgtgggtctccccggccccagcttcttagacttcgagggcacggcgagctcacaggggccacagagccgaaggacagaggaggctgcaggggcagggagggcccaaggcagaggccggccggccaagggcaggcgggcctcctacaagtgcaaagtgtgcttccagcgcttccgcagcctgggcgagctggacctgcacaagctggcccacacgcccgcgccgccgcccacctgctacatgtgcgtggagcgcaggtttggctcgcgggagctgctgcgggggcacctgcaggagaggcacgcgcagagcaaggccgggccctgggcgtgcggcatgtgcctgaaggaggtggccgacgtctggatgtacaacgagcacctgcgtgagcacgcggtccgcttcgcccgcagggggcaggcgcggaggtccttgggggacctgcccggaggcctggagggcagcagcgctgtcgcccaccttctgaacagcatcacggaacccgcgcccaaacaccacaggggcaagcgctccgccggcaaggccgccgggagcccgggagacccgtgggggcaagagggagaagccaagaaagacagcccgggcgagagggcgaaaccccgggcacgcagcacccccagcaacccagacggggccgcgaccccagacagcgcctctgccaccgccctggctgacgccggcagcccgggcccccccaggacgacccccagcccgtcccccgacccctgggccggcggggagcccctcctgcaagccaccccggtgcacgaggcctgcaaggacccctcccgcgactgccaccactgcgggaagcgcttccccaagcccttcaagctgcagcgccacctggcggtgcacagcccgcagcgcgtctacctgtgcccccggtgcccccgggtctaccccgagcacggggagctgctggcacacctgggcggggcgcacgggctgctggagcggccggagctgcagcacacgccgctgtatgcctgcgagctctgcgccacggttatgcgcatcatcaagaagtccttcgcctgcagctcctgcaactacaccttcgccaagaaggagcagttcgaccgccacatgaacaagcacctcaggggggggcggcagcccttcgcgttccgcggcgtgcggaggccgggagcgccgggacagaaggcccgggccctcgagggcacactgcccagcaaacggcgcagggtggccatgcccggcagtgcccctgggcccggcgaggacaggcctcctccccggggaagcagccccatcctgagtgagggctctctcccggccctgctccacctgtgttcggaggtggctcccagcaccaccaagggatggcccgagaccctagagaggcctgtagaccccgtgacccacccgatcagaggttgtgagctgccatccaaccaccaggagtgtcccccgccgtctctgtctcccttcccagctgccttggctgatggcagaggagactgcgcgctggacggagccctggagaggccagagaacgaggcttccccaggcagccccgggcctcttctccagcaagctctccctctgggggcatctctgccgcggccgggagccagaggccaagatgcggagggaaagagggctcctctcgtgttctcagggaaacgcagggccccgggtgcccgtggcaggtgtgcccctgaccatttccaggaagaccacctacttcagaaagagaaggaggtgtcctcaagccacatggtgtctgagggggggccccgaggcgccttccacaagggcagcgccaccaagcctgcgggctgccagagctcatcaaaggacaggtcggcagcatccacccccagcaaagcactcaagttcccagtgcacccaaggaaggcggtggggagcctggcacccggggagctggcccgtggcacagagaatgggatgaagcccgccacccccaaagccaaacccggccccagctcccagggcagtggaagccctcgccccggcaccaagacaggaggtggcagccagccccagccagccagcgggcagctccagagcgagacagccaccaccccagccaagcccagcttccccagccggagccctgcaccagagaggctccccgctcgagcccaagccaagagctgcaccaaggggccaagggaagctggtgagcaggggccccacgggagcctaggtcccaaggagaagggagagagcagtacgaagaggaaaaagggccaggtcccagggccagccaggagtgaaagtgtggggagcttcgggagagccccctcagcccctgacaagcccccccggacccctcggaagcaggcaactcccagccgcgtgctcccgaccaagcccaagcccaacagccagaacaaacccaggccgccaccatcagagcagcggaaggcagagccgggccacacacagaggaaggacagactgggcaaggccttcccccaggggagacccctgctcaggccccccaagaggggcacagctgtccacggtgctgaacctgccgagccacacacccaccggacggccgaggcccagagtgacctcctcagccagctcttcgggcagagactaactggcttcaaaatccctttaaagaaagatgcttccgagtaatttctaggagcaagagcctgggaccggagctgggcgttcctgtctcggcctgcctccttggccagctccggctccctgagatggtccactctgtggccacttgacttcttgtgcaactgctcaggccttgatgtcagagctgaggtggtgatgctttgaacagggcccaggtgggcagcattccctttcttgctggaaggctgggggtgaaagacggggccactgcagcccttttgagaccacacagctgttttcttggtaccaagtacttgaagagacagcagcccatcccctcagcccacacccctgcgccctgtgggcaccgacaccacagaagccaatgtttggagatttgcacaacctcccgttcccccacatggagaagggaagtaagttgaggcagccgtgggatggtggtaggttccctcttagtcttgctgctgttgctggaattccaaagtgaccttagaaaccacgtgggggaaggcagtgctcactacttagaagggttgcttctgagccgcctggtcccccaagagcacaacaggcctcctccctctgaccacagggtcatgcctcctccctctgaccacagggtcatgccagcctccatttgctctgcgggagaaaagcccatctctagcacaccttgaccccaggaaccgggttcccgtatggaactgggaagaaaccgcccctgtgccagctcccgcgggccctcctcgttccctcccagcctccatggccgccctctagagcctccctgctgtacggagctctgggctccgcctatttgcaatgttactctgaagtttctggtgctatttttgtgttgtaatgtgaatacaggcttccttgatttttttttttaatgggggtattgggtgggacagacggggtcagggaggccccaccatggcttgtcgagggcacgggcacctgcatggcggcgctctccctgcctcccctgccgggctgcaagcctgaggtctgtgctgccagacggggatgctcagggctggggctgcagagccgctgccctggccagggcaccctcatgcaccgacccaacccaggcctgggacgcacgtgtcctctcacagcgtcgtgcctgtgaaggtgggtcaaagggtgagagggcttccttctcacccttctctccataagtatcttgaagatccatggtttgttttgctctattgtttagtttttacttgggtgcaatgtgtacgtcaaaagtttttattttgatatttgaaagagaccaaatcaggcccagaccgcctctctggaaggtgttgtaggccattcaaaacgcctccggagtgtcgcaaaccaagtgcggaggggccctgaggttgtactgtaaacatcatagtgacttgtcttttcaaatatattcccactattttcgcag

SEQ ID NO: 202633 - DNA, 7151 bp, Homo sapiens
  Payload ID: 19960
  Gene Name: zinc finger protein 470
  Uniprot ID: Q6ECI4
  ENST ID: ENST00000330619
  CDS Start-End: 687-2840
ggttgctgaggagaagggaggtctgggcggggcagcggccgaggctggactggggcgcggcgggggcggtgtcctggttcctgtgtgggcggcgggcgtgagcgtgcgcgtgtggcctggtggctgtgagtgcccatacgtggtgagcgtgcggtgctgtgctgaggaggggcgagcgcgcgcggggatggcggcccggtgtgtgactgtccggtgcgtggccgcgaatctgcgcctgcgtgcatggcccggcggcgtgcggaaggcggtgtgtgttggaatgagtgaagcactttaagtggccaagagcaggaaacccggccggaggaggcttaccccgttctcccctgtatcgactgcgtagagcccagtgtgggcaaagtcctagagcccggggaagttgcccgggcggggcagcctcggctgaagcatttcctgtcagccctatctggaaggggcagagcccaggacagggctccatgtccacaggacggcgaggagcgaagaccatggggactgagtacacagatgaagacacagaagcatagagaggataagtaatcactagcaagtggaagaaccgggattcagatccagaacaggctgactccagagtcactggctgtcatgtagtttcctcaactactgcctcagctctacaatcccagagtaaagctcttctccaaatgaagagccaggaagaggtagaggtggcaggaattaaactttgtaaagccatgtccctgggttcagtgactttcacagatgtggccatagacttttcccaagatgaatgggagtggctgaatcttgctcagagaagtttgtacaagaaggtgatgttagaaaactacaggaacctagtttcagtgggtctttgcatttctaaaccagatgtgatctccttactggagcaagagaaagacccttgggtgataaaaggagggatgaacagaggcctgtgcccagacttggagtgtgtgtgggtgaccaaatcattatctttaaaccaggatatttatgaagaaaaattacccccggcaatcataatggaaagacttaaaagctatgaccttgaatgttcaacattagggaaaaactggaaatgtgaagacttgtttgagagggagcttgtaaaccagaagacacattttaggcaagagaccatcactcatatagatactcttattgaaaaaagagatcactctaacaaatctgggacagtttttcatctgaatacattatcttatataaaacagatttttcccatggaagagagaatatttaattttcatacagataagaaaagcttaaaaacacattcagttgtgaaaaaacacaagcaagaccgtggagaaaagaaacttttaaaatgtaatgactgtgagaaaatattcagcaaaatctcaacccttactcttcaccaaagaattcatacaggagagaaaccctatgaatgtattgaatgtggaaaggcctttagccagagtgcccaccttgctcaacatcagagaatacacacaggagaaaaaccttttgaatgtactgaatgtgggaaagccttcagccagaatgctcatcttgttcaacaccagagagttcatactggagagaaaccttatcagtgtaagcagtgtaataaagcattcagccagcttgcacaccttgctcaacatcagagggtccacactggagagaaaccctatgaatgtattgaatgtgggaaggcttttagtgattgctcatccctagctcatcatcgaaggattcacactgggaaaagaccttatgaatgtattgactgtgggaaagctttcaggcagaatgcttctcttatacgtcatcggcgatattatcatactggagagaaaccctttgactgtattgattgtgggaaggctttcactgatcacataggacttattcagcataagagaactcatactggagagagaccttacaaatgtaatgtgtgtgggaaggcttttagccatggctcatctctgacagtacatcagagaattcatacaggagagaaaccttatgaatgcaatatctgtgagaaagccttcagccatcgtgggtctcttactcttcatcagagagttcatactggagagaaaccctatgaatgtaaagaatgtgggaaagctttccggcagagcacgcatctggctcatcatcagagaattcatactggagagaaaccttatgaatgtaaggaatgcagcaaaaccttcagccagaatgcacacctcgcgcaacatcagaaaatacacactggggagaaaccttatgaatgtaaggaatgtggtaaggccttcagtcagattgcacaccttgttcagcaccagagagttcatactggtgagaagccttacgaatgtattgaatgtgggaaggcctttagtgatggctcatatcttgttcaacatcagagactccacagtggcaaaagaccgtatgaatgtcttgaatgtgggaaggcattcaggcagagggcatccttgatttgtcatcagagatgtcatactggtgagaaaccttatgaatgtaatgtttgtgggaaagcctttagccatcgtaaatcccttactctgcatcagagaattcatacaggagagaaaccttatgagtgtaaggaatgtagcaaagccttcagccaggttgcccatcttactctacataagagaattcatactggagaaaggccctatgagtgtaaagaatgtggaaaagccttcaggcagagtgtacatcttgctcatcatcagcgaattcataccggagagtcatcagttattctctcctctgccctcccataccaccaagtcctatagattcaatctcgtaaatgcttctagcatccatctgcttttttccagcacatgtcccatcatcatagtccaagacgcaaccatctcatctggatttctgcagtagcataactgttgccccttttgcttctatcaactacatgtttaacactgtaggcagcctaaccttttaaaaataaaaatacataatttatgttattttcccatttaaaacacttgatttgaaaaatatattaactaatccatttcaaggatttagcacacactggcatatagttattgctaaataaatgctagccattaaggtaaaggtttccttacaaactatcatattaagcagcaagtaaaccaaacagtaagtctaagactaagattttagagcagacagaagactactctcctggtagagaggaaagatgaacaaactcagaattgaaagatttatggtacacaaggtaacatggtggcttatcactccctctgtgacattgttgatgagcaactctcactttacctgacactgagaagtgagaatcagccaattagaacaaaagcttttagctgggtgcggtggctcatgcctgtagtcccagcactttgggaggctgaggcaggcagattgcttgagctcaggagttcgagaccaacctgagcaacatggtgaaaccctgtctctacaaaaaatacagaaattagccaggcgtggtggtgcacacctgtagtcctagctactcaggaggctgaagcaggaggattgcttgagcccaggaggtagaggttgcagtgagtcatgatcacaccactgcaattccagctgggcagcagagccagacactgtctcaaggaaaaacaaagaacaaaagcatttggtagaatgtaggactaaccagggtaggtagtagtaaaccaaaagtaacaagccaaaaaaacttgaatagattaatagccatgaaacactgaaaagggtagttcaatactttggcctttataaaagtaccacagacaattcgtgtggtatttaaattgttctagcataaaataaaatgcaataagaccttccatcttgttccatgagattgacaagacatgccaaaacataaaaatatgtacactgcaattagtttctgaatgtagatgttacaacttaaacttatttttaaaatatttaaaaataggaaggctagacatgcctctgtatagaaaatctgataaaaatatttctccctaaattgtaaattcattgatattccagtaaaaatttccatatttttttagttgagaagctgattctgatcatctgtagaattttgattttaacgaggaatgtagtttacattaggaatgtagtactaatactaattgaacatttgctaatgtttcacacactattttaggtgctgggggatacagtaaggtacaagatggacaaaaatacgtgctcttacagatctagtagaacagaaaaaattaaatgcatgctatgtgataagtatatgatatgtcccataaagagaaatgatataaaaaagaagctagggagtgctggatcaggcaccttactatccccagaacatgttggtattagaggatgagggaagaactagaggtaactgtgagacacaaaaggcataatgaaaatagtcatgatagtcccaaggcagatattgtttatgatgctttgagtgttggaggaagggaggattgatggtttaacagagatcatggcagttatgttcactcatataaatgttgatttagaagctggtggaagggtattttttgagtgacagctttattgagacaaagcaattctggagaacacccatatccttctctctgtatccatcagcagaagtgaagagggagccccaaagttccacttaaagtgtacaacttatggcttttagttcattcacggagttgtgcaaccatcaccaccatcaattttagaacattttcatcacctcaaagaggaatcccttgtccttttgtagttatggccatccctggaagagtacttttttttttttttcaactgaagcacccagagctcttgggttccctcttaactgctttctgtggaagtatagagggccatgtgagggaagccgttatccagagtacatgactgctagaaaatggagtttggggctccctcttcacttctgctgatagaagcataatggctaggggatgggtagtctcaccagagaatgtggagctttcagactctccttatatatgataaaaaggatttttcattgtagtggggaaaaggtggtttgatcaaatggcattgggaaacttagctcactggaaaaacagatctgtacctttcacactaatgaaatgcctgagatattaaaggtctaaatgtaaaattaaagtacatgaaaaacagaataatatatatgtaccctcggtttgaaatagactttaagcactaatgcataaccccaaagctgacattaggcttttatatggtggaaaacatcatagtcaatagataaatgagagactgacacaaagtgtttgcaacagatataataaaggactgtaattcgtgatattcaaagtactattacaaaccaataataatctgcaacttagaaaaatggactaatgtcccattcacaaaagatgcaataaaagcagttaatgaaaattatccaatatcactagaaatcaagaaatgcaaattaaagtgattatctactttttccccaaaagactgactaatcgagtgataacattcagtattggtgaatgtgtggaaacaagggaattccattgttgattacatatctattgctttatgtatataccctttgaattaatattccttggaaaccaacatatacaaaggtagataaatgtattagtggcaaaaaaattaatggtaaactattaaaacaacaagtgtccatcagggtaataaataaattaattatggtatatatccattcaataggaattatgcagctgttgaaaaaaaatcaatgtgtgtagtcatagaaagatagctgtgctatactaaatgaaaaattgcagacctgtattgtagtataggcccataattgtgatatcaaaaataaaaatcaaaatatatattatagtaggcatttgtttttctctgcccagtttcccttgcctcctccttttggctgcactatctcatcttttccttttgagtaactggccataccctaccatatgtttttgatggacgtggccaataaaattgtctctgaatttcaaaaggcatttggatctgtgtcatccaatggcaactccctaaaagctgatgcagttattcttttgattggtccttggaaccaccctggtttttgtactttccaagtctgtgattcctcaaactacccattgtctttccggtacttgatttttgcctcctgttggtcagttgcttgcaagtaaagaaacaatcatacagaatttggtacgaagattgggtaatgggcattagaatctttggaaaaatcaggtattgggagttgctttttggatgagatggggcgaataagacttatattctagactggaaagcatctcatggtgtgcgatgagcaaacgcctgattattcattatagtcacctgggatgaatagaggtctagggttctggataatgataatttaaggaggatggagaatgctgaatccaaaaggtatatgtaatactggtatctaactgcttggaataacttaaagtttagctcttgaatttctagcattaaggcaaaaaaaattcacctaagggattttgtatgatattgttgaaagatgtcttacattgtttaaagtcatagggttaagatggctcataaccaaatttagagactatttttatgcattgttaaagtggaatgctggttaaattttatactttattcacaagagtcactgtgaattgaattgtgaattcagttctgaattgtgttcccaccagcaccaccaaatgctggcctctaccaccaccaaatttacttgttgaagtcctaaaccccaacatgactgtatttggacataaggcctttaagaaactaaggttaagttaggccataagagtgaggccctaatcccataggactagtgtccttataagaggaagagacaccagaggtttgtctctccacatgtgcacagaggaaatgctgtgtaaggacacaacaagaatgctgccatctgcaagccaggaggagagacctcaccaggaaccagccctgccagcaccttgatcttggacttttaatctccaggactgtgagaaaataaatgttggttgtttaagcca

SEQ ID NO: 202634 - DNA, 6601 bp, Homo sapiens
  Payload ID: 19960
  Gene Name: zinc finger protein 470
  Uniprot ID: Q6ECI4
  ENST ID: ENST00000391709
  CDS Start-End: 138-2291
agtgaggactgtgagtgaggacagaagaagctgaagggaagaaagcattttcagactttgattattagtgctacttggtttctcactacttctttttctccccagctctacaatcccagagtaaagctcttctccaaatgaagagccaggaagaggtagaggtggcaggaattaaactttgtaaagccatgtccctgggttcagtgactttcacagatgtggccatagacttttcccaagatgaatgggagtggctgaatcttgctcagagaagtttgtacaagaaggtgatgttagaaaactacaggaacctagtttcagtgggtctttgcatttctaaaccagatgtgatctccttactggagcaagagaaagacccttgggtgataaaaggagggatgaacagaggcctgtgcccagacttggagtgtgtgtgggtgaccaaatcattatctttaaaccaggatatttatgaagaaaaattacccccggcaatcataatggaaagacttaaaagctatgaccttgaatgttcaacattagggaaaaactggaaatgtgaagacttgtttgagagggagcttgtaaaccagaagacacattttaggcaagagaccatcactcatatagatactcttattgaaaaaagagatcactctaacaaatctgggacagtttttcatctgaatacattatcttatataaaacagatttttcccatggaagagagaatatttaattttcatacagataagaaaagcttaaaaacacattcagttgtgaaaaaacacaagcaagaccgtggagaaaagaaacttttaaaatgtaatgactgtgagaaaatattcagcaaaatctcaacccttactcttcaccaaagaattcatacaggagagaaaccctatgaatgtattgaatgtggaaaggcctttagccagagtgcccaccttgctcaacatcagagaatacacacaggagaaaaaccttttgaatgtactgaatgtgggaaagccttcagccagaatgctcatcttgttcaacaccagagagttcatactggagagaaaccttatcagtgtaagcagtgtaataaagcattcagccagcttgcacaccttgctcaacatcagagggtccacactggagagaaaccctatgaatgtattgaatgtgggaaggcttttagtgattgctcatccctagctcatcatcgaaggattcacactgggaaaagaccttatgaatgtattgactgtgggaaagctttcaggcagaatgcttctcttatacgtcatcggcgatattatcatactggagagaaaccctttgactgtattgattgtgggaaggctttcactgatcacataggacttattcagcataagagaactcatactggagagagaccttacaaatgtaatgtgtgtgggaaggcttttagccatggctcatctctgacagtacatcagagaattcatacaggagagaaaccttatgaatgcaatatctgtgagaaagccttcagccatcgtgggtctcttactcttcatcagagagttcatactggagagaaaccctatgaatgtaaagaatgtgggaaagctttccggcagagcacgcatctggctcatcatcagagaattcatactggagagaaaccttatgaatgtaaggaatgcagcaaaaccttcagccagaatgcacacctcgcgcaacatcagaaaatacacactggggagaaaccttatgaatgtaaggaatgtggtaaggccttcagtcagattgcacaccttgttcagcaccagagagttcatactggtgagaagccttacgaatgtattgaatgtgggaaggcctttagtgatggctcatatcttgttcaacatcagagactccacagtggcaaaagaccgtatgaatgtcttgaatgtgggaaggcattcaggcagagggcatccttgatttgtcatcagagatgtcatactggtgagaaaccttatgaatgtaatgtttgtgggaaagcctttagccatcgtaaatcccttactctgcatcagagaattcatacaggagagaaaccttatgagtgtaaggaatgtagcaaagccttcagccaggttgcccatcttactctacataagagaattcatactggagaaaggccctatgagtgtaaagaatgtggaaaagccttcaggcagagtgtacatcttgctcatcatcagcgaattcataccggagagtcatcagttattctctcctctgccctcccataccaccaagtcctatagattcaatctcgtaaatgcttctagcatccatctgcttttttccagcacatgtcccatcatcatagtccaagacgcaaccatctcatctggatttctgcagtagcataactgttgccccttttgcttctatcaactacatgtttaacactgtaggcagcctaaccttttaaaaataaaaatacataatttatgttattttcccatttaaaacacttgatttgaaaaatatattaactaatccatttcaaggatttagcacacactggcatatagttattgctaaataaatgctagccattaaggtaaaggtttccttacaaactatcatattaagcagcaagtaaaccaaacagtaagtctaagactaagattttagagcagacagaagactactctcctggtagagaggaaagatgaacaaactcagaattgaaagatttatggtacacaaggtaacatggtggcttatcactccctctgtgacattgttgatgagcaactctcactttacctgacactgagaagtgagaatcagccaattagaacaaaagcttttagctgggtgcggtggctcatgcctgtagtcccagcactttgggaggctgaggcaggcagattgcttgagctcaggagttcgagaccaacctgagcaacatggtgaaaccctgtctctacaaaaaatacagaaattagccaggcgtggtggtgcacacctgtagtcctagctactcaggaggctgaagcaggaggattgcttgagcccaggaggtagaggttgcagtgagtcatgatcacaccactgcaattccagctgggcagcagagccagacactgtctcaaggaaaaacaaagaacaaaagcatttggtagaatgtaggactaaccagggtaggtagtagtaaaccaaaagtaacaagccaaaaaaacttgaatagattaatagccatgaaacactgaaaagggtagttcaatactttggcctttataaaagtaccacagacaattcgtgtggtatttaaattgttctagcataaaataaaatgcaataagaccttccatcttgttccatgagattgacaagacatgccaaaacataaaaatatgtacactgcaattagtttctgaatgtagatgttacaacttaaacttatttttaaaatatttaaaaataggaaggctagacatgcctctgtatagaaaatctgataaaaatatttctccctaaattgtaaattcattgatattccagtaaaaatttccatatttttttagttgagaagctgattctgatcatctgtagaattttgattttaacgaggaatgtagtttacattaggaatgtagtactaatactaattgaacatttgctaatgtttcacacactattttaggtgctgggggatacagtaaggtacaagatggacaaaaatacgtgctcttacagatctagtagaacagaaaaaattaaatgcatgctatgtgataagtatatgatatgtcccataaagagaaatgatataaaaaagaagctagggagtgctggatcaggcaccttactatccccagaacatgttggtattagaggatgagggaagaactagaggtaactgtgagacacaaaaggcataatgaaaatagtcatgatagtcccaaggcagatattgtttatgatgctttgagtgttggaggaagggaggattgatggtttaacagagatcatggcagttatgttcactcatataaatgttgatttagaagctggtggaagggtattttttgagtgacagctttattgagacaaagcaattctggagaacacccatatccttctctctgtatccatcagcagaagtgaagagggagccccaaagttccacttaaagtgtacaacttatggcttttagttcattcacggagttgtgcaaccatcaccaccatcaattttagaacattttcatcacctcaaagaggaatcccttgtccttttgtagttatggccatccctggaagagtacttttttttttttttcaactgaagcacccagagctcttgggttccctcttaactgctttctgtggaagtatagagggccatgtgagggaagccgttatccagagtacatgactgctagaaaatggagtttggggctccctcttcacttctgctgatagaagcataatggctaggggatgggtagtctcaccagagaatgtggagctttcagactctccttatatatgataaaaaggatttttcattgtagtggggaaaaggtggtttgatcaaatggcattgggaaacttagctcactggaaaaacagatctgtacctttcacactaatgaaatgcctgagatattaaaggtctaaatgtaaaattaaagtacatgaaaaacagaataatatatatgtaccctcggtttgaaatagactttaagcactaatgcataaccccaaagctgacattaggcttttatatggtggaaaacatcatagtcaatagataaatgagagactgacacaaagtgtttgcaacagatataataaaggactgtaattcgtgatattcaaagtactattacaaaccaataataatctgcaacttagaaaaatggactaatgtcccattcacaaaagatgcaataaaagcagttaatgaaaattatccaatatcactagaaatcaagaaatgcaaattaaagtgattatctactttttccccaaaagactgactaatcgagtgataacattcagtattggtgaatgtgtggaaacaagggaattccattgttgattacatatctattgctttatgtatataccctttgaattaatattccttggaaaccaacatatacaaaggtagataaatgtattagtggcaaaaaaattaatggtaaactattaaaacaacaagtgtccatcagggtaataaataaattaattatggtatatatccattcaataggaattatgcagctgttgaaaaaaaatcaatgtgtgtagtcatagaaagatagctgtgctatactaaatgaaaaattgcagacctgtattgtagtataggcccataattgtgatatcaaaaataaaaatcaaaatatatattatagtaggcatttgtttttctctgcccagtttcccttgcctcctccttttggctgcactatctcatcttttccttttgagtaactggccataccctaccatatgtttttgatggacgtggccaataaaattgtctctgaatttcaaaaggcatttggatctgtgtcatccaatggcaactccctaaaagctgatgcagttattcttttgattggtccttggaaccaccctggtttttgtactttccaagtctgtgattcctcaaactacccattgtctttccggtacttgatttttgcctcctgttggtcagttgcttgcaagtaaagaaacaatcatacagaatttggtacgaagattgggtaatgggcattagaatctttggaaaaatcaggtattgggagttgctttttggatgagatggggcgaataagacttatattctagactggaaagcatctcatggtgtgcgatgagcaaacgcctgattattcattatagtcacctgggatgaatagaggtctagggttctggataatgataatttaaggaggatggagaatgctgaatccaaaaggtatatgtaatactggtatctaactgcttggaataacttaaagtttagctcttgaatttctagcattaaggcaaaaaaaattcacctaagggattttgtatgatattgttgaaagatgtcttacattgtttaaagtcatagggttaagatggctcataaccaaatttagagactatttttatgcattgttaaagtggaatgctggttaaattttatactttattcacaagagtcactgtgaattgaattgtgaattcagttctgaattgtgttcccaccagcaccaccaaatgctggcctctaccaccaccaaatttacttgttgaagtcctaaaccccaacatgactgtatttggacataaggcctttaagaaactaaggttaagttaggccataagagtgaggccctaatcccataggactagtgtccttataagaggaagagacaccagaggtttgtctctccacatgtgcacagaggaaatgctgtgtaaggacacaacaagaatgctgccatctgcaagccaggaggagagacctcaccaggaaccagccctgccagcaccttgatcttggacttttaatctccaggactgtgagaaaataaatgttggttgtttaagcc

SEQ ID NO: 202635 - DNA, 1640 bp, Homo sapiens
  Payload ID: 19960
  Gene Name: zinc finger protein 470
  ENST ID: ENST00000601902
  CDS Start-End: 672-980
gggaggtctgggcggggcagcggccgaggctggactggggcgcggcgggggcggtgtcctggttcctgtgtgggcggcgggcgtgagcgtgcgcgtgtggcctggtggctgtgagtgcccatacgtggtgagcgtgcggtgctgtgctgaggaggggcgagcgcgcgcggggatggcggcccggtgtgtgactgtccggtgcgtggccgcgaatctgcgcctgcgtgcatggcccggcggcgtgcggaaggcggtgtgtgttggaatgagtgaagcactttaagtggccaagagcaggaaacccggccggaggaggcttaccccgttctcccctgtatcgactgcgtagagcccagtgtgggcaaagtcctagagcccggggaagttgcccgggcggggcagcctcggctgaagcatttcctgtcagccctatctggaaggggcagagcccaggacagggctccatgtccacaggacggcgaggagcgaagaccatggggactgagtacacagatgaagacacagaagcatagagaggataagtaatcactagcaagtggaagaaccgggattcagatccagaacaggctgactccagagtcactggctgtcatgtagtttcctcaactactgcctcagctctacaatcccagagtaaagctcttctccaaatgaagagccaggaagaggtagaggtggcaggaattaaactttgtaaagccatgtccctgggttcagtgactttcacagatgtggccatagacttttcccaagatgaatgggagtggctgaatcttgctcagagaagtttgtacaagaaggtgatgttagaaaactacaggaacctagtttcagtgggtctttgcatttctaaaccagatgtgatctccttactggagcaagagaaagacccttgggtgataaaaggagggatgaacagaggcctgtgcccagatatcctgaaaatgccacatcagtaagttgaacaagaagaacgggagctttaagaacaagattcaagatgaaacaacacaagtgttgaatattttataaatagctaaaggcagaaaacgttgccaattatctcagacttccagaaagtgaaaacaaacaaacaaacaaactaaagtcttaattgaaaagaagaaagaaagacatgaagaaagaaatagagaatgcatgttgagagtggggacaggtaagtaccagctggactcttaccctgggctgttggtcctgaggatgcggtataggttcagcctaggcactggctccaccccttgaaatagtttggatatttgtccctgcccaaaatctcatgttagattgtaatccccagtgctggagatggggcctggtgggaggtgtttggatcatggggcaggtccctcatggcacggtgctgtcttctcgataatgagtgagttcttgtgagattaggtcctttaaaaatgtgtggcacatttcgccccttctgtcttgctcatgtgtttttgccatgtgatgtgcggctcccctttcaccttttgccatgattgtaagcctcctgtggcctccccagaagtcaagcaaatgccaatgtcatgtttgctgtacagcctgcagaactgtgagccaattaaacctcttttccttataaa

SEQ ID NO: 202636 - DNA, 433 bp, Homo sapiens
  Payload ID: 19960
  Gene Name: zinc finger protein 470
  ENST ID: ENST00000594953
  CDS Start-End: 1-140
tttctaaaccagatgtgatctccttactggagcaagagaaagacccttgggtgataaaaggagggatgaacagaggcctgtgcccagcaccaccaaatgctggcctctaccaccaccaaatttacttgttgaagtcctaaaccccaacatgactgtatttggacataaggcctttaagaaactaaggttaagttaggccataagagtgaggccctaatcccataggactagtgtccttataagaggaagagacaccagaggtttgtctctccacatgtgcacagaggaaatgctgtgtaaggacacaacaagaatgctgccatctgcaagccaggaggagagacctcaccaggaaccagccctgccagcaccttgatcttggacttttaatctccaggactgtgagaaaataaatgttggttgtttaagccac

SEQ ID NO: 202637 - DNA, 6287 bp, Homo sapiens
  Payload ID: 19961
  Gene Name: zinc finger protein 471
  Uniprot ID: Q9BX82
  ENST ID: ENST00000308031
  CDS Start-End: 134-2014
cctgcgcgatggggggttccagcgtcgactcacggagtccttcggatgagagcgtctgggtgccagacgaggccggggccttgccctcccaagacactgttcttcaagagaaagaccagaagagaaggcaaaaatgaatgttgaagtagtaaaagtcatgccccaggacttagtgacattcaaggatgtggcaatagatttttcccaggaagaatggcaatggatgaaccctgctcagaagcgtttatacaggagtatgatgttggagaactatcagagcctggtatcacttggtctttgcatttctaagccatatgtgatctccttattggagcaagggagagagccttgggagatgacgagtgagatgacaagaagcccattctcagattgggaatctatatatgtgacacaggaattacctctgaagcagttcatgtatgatgatgcatgcatggagggaattactagctatggacttgagtgttccacttttgaagaaaattggaaatgggaagacctttttgagaagcagatgggaagtcatgagatgtttagcaagaaagaaataatcactcataaagaaaccatcactaaggaaacagaattcaaatatactaaatttgggaaatgtatccatctggaaaacatagaagagagtatttataatcacacatcagataaaaaaagcttctccaaaaattctatggtaataaaacacaagaaagtctatgtaggaaagaagctttttaaatgtaatgaatgtgacaaaaccttcacccatagctcatcccttactgttcattttagaattcatactggtgaaaaaccatatgcatgtgaggaatgtggaaaagccttcaagcaaaggcaacaccttgctcaacatcacagaacacatactggagagaaactctttgaatgtaaagaatgtaggaaagccttcaaacaaagtgaacaccttattcagcatcaaagaattcatactggagaaaaaccatataaatgtaaggaatgcagaaaagccttcagacagcctgcacaccttgctcagcatcagagaattcatactggagagaaaccctatgaatgtaaagaatgtggcaaagccttcagtgatggctcgtcttttgctcgacatcagagatgtcacactggcaaaagaccctatgaatgtattgagtgtgggaaggcttttaggtataacacatcttttattcgtcactggaggagttatcatactggagagaagccttttaattgcattgattgtgggaaagccttcagtgttcacataggacttattctgcataggagaattcatacaggagagaaaccttacaaatgtggtgtgtgtggaaaaaccttcagctcgggttcatcccgtactgtacatcagagaattcatacaggagagaaaccttatgaatgtgatatatgtgggaaagattttagccatcatgcatcactcactcagcatcaaagagtacattctggagagaaaccgtatgaatgcaaggaatgtgggaaagcctttaggcagaatgtacaccttgttagtcatttgagaattcatactggtgaaaaaccctatgaatgtaaagaatgtggaaaagcttttagaatcagttcacagctggctactcatcagagaattcatactggagagaagccttatgaatgtattgaatgtggaaatgctttcaaacagagatcacaccttgcccaacatcagaaaactcatacaggagagaaaccttatgagtgtaatgaatgcgggaaagccttcagccaaacttccaatcttactcaacatcaaagaattcatactggagagaaaccctataaatgtactgaatgtggaaaggcttttagtgatagctcatcctgtgctcagcatcaaagactccacactggccaaaggccctatcagtgttttgaatgtgggaaggcgttcagaagaaagttatccttaatttgtcatcaaagaagtcatactggagaagaaccttaagaatgtagtgcatgtggccaagcctttagttatcaccaatcccctactgttaatcagagatgtcccactggataaaaaacatataaatgtaagaaatgtagaaaaaccttcagccaggaggctggcaagatggccgaataggaacagctctgatctgcagttcccagtgagatcaacgcagaaggtgggtgctttctgtatttccagctgaggtacctggctcatctcattgggactggttagacagtgggtgcagcccacggagggtgagctgaagcagggtggggcgtaacctcacctgggaagtgcaaggagtcggggatctccctcccctagccaagggaagccatgagggactgtgccatgaggaatggtgcactccggcacagatactacgcttttcccatggtcttcgcaacccacagaccaggagatcccccttgggtgcctatgccaccaaggccctgggtttcaagcacaaaactgggcggccattcgggcagacaccgagctagctgtaggagtttttttgatagcccagtggcacctggaatgccagtgaaacagaaccgcttactcccttgttaagggggctgaagccggggagccaagtggttcccatgcccactgagcccagcaagctaagatccactggcttggaattctccctgccagcacagcagtctgaagtcaacctgggatgatcaagcttggtggggggaggggcgccaaccattaccaaagcttgaataggtggttttcccctcacagcgtaaacaaagccatggggaagttccagctgagcagagccctccacagctcagcaaagcctctgtagccagactgcctctctagattcctcctctctgggcagcgcatctttgaaaaaagtgcagataaaaccctcatctccctgggacaaagcacgtgggggaaaggggtggctgtgggcacagcttcagcagacttaaacattcctgcctgccagctctgaagagagcagcagttcttccagcacagcgcttgagctctgctaagggacagactgcctcctcaagtgggtccctgacccccatgcctcctgacggggagacacctcccagcaggggtccacagacacctcatacaggagagctctggctggcatctggtgggtgcccctctgggacaaagcttccagaggaaggaacaggcagcaatctttgctgttctgcagcctccaccggtgatacccaggcagatatggtctggagtggacctccagcaaactccagcagacctgcagccgaggggcctcactgttagaaggaaaactaacaggaatataatcaacatcaacaaaggacatccacacagaaaccccatctgaaggttaccagcatcaaagaccaaaggtagataaattcacgaagatgaggagaaaccagtgcaaaaagcctgaaaattccaaaaaccagaatgcctcttctcctccaaaggatcacaactccttgccggcaagggaacaaaactggatagagaatgagtttgacaaattgacagaagtaggcttcagaaggtgggaaataacaaactcctctgagctaaaggagcatgttctaacccaatgcaaggaagctaagaaccttgaaaaaaggttagaggaattgctaactagaataaccagtttagagaagaacataaatgacctgatggagctgaaaaacacagcatgagaacttcgtgaagcatacagaagaaaaaccttcagccagattgaatgctttacagggaagaattcatactgcagagcggtcttaacaatgtaaagaatgtgcaaatgtcctcagacaagatgcacaccttgctcattagtgagttcatttcaggcagccagctcttcctcacccactacatcaccaagtcctgtggatatatctgctaaatatttttggaatttatccacttcttttggttccccagtccaaaacacagtcatttcacctggactatttcaatcattacacaggtgtccaaccttttgtcttccctgggccacattggaagaagaaaaattgtcttgtgccacacatacaatacactaacattaacaatagctgatgagctaagaaaaaaaaaaagtctgtgcatagttttagtgatacaccacctccgataagcaaaaaagtcctcacattcaatgggttgcatacccatgaattctaaaacttcatcctcttttgtccctttcgagttaacattacagccacagtgacctttcaaaaatgcaaattaagttactcttaaaactctagttaaaatacttgatgtacataaagtgcttagcaaaatgaccaactcatactaagtgcttagtaaatgttagataagtattctccagaattgatgtaaattatttttaaacagtgcattcttgaaagcagtatggcagtcataaaaattttggaaccaaaacagtatctttttttaagctaaaaaaaaagttttaaatggtgtctttctatgttgcccagggtggtctcaaactcctgtgctcaagtgaccctcccacctcattctcaagtggctgcaattacaggcaaccagcctgacttaaaacagtatcttaaggtagatggtgattagcacatgtagtatgcttaacatttaatattataataagacatcacagcggctgtctcatgattaaggctgtgttcccttgttggtgaggaaattaattatgacttgataaatagaacatgttttaagaagtggctatatagctctggataaaacgaacaaaagaattagaattcctgcggggaatatatacaagactttatttagtcaagtaaaaaaaaatcactaatgtttaactgaagaaagagaaattgaataatatagttctatttcaacatgtgggttcacagatttattctaaccttccaagtaaagttgttccactagtaaagttgttctggagtatattttttttaaaaaaaacacttaaaatgttccacttctttcatgaggctaagtcaactctgatatcaaaccaaggggaaagaaatgaaattataggtgagtttacttagttatatacaaaaggaaattattagcctctgctgatggagaacagaggctgtgaataaatggagatccataacatgatcctacatgaatgtttcaatattgtaatcctgtaagttacttttacattgacagttctgaaattcatgttgagtgttaattaggcaggaatcagaagggaggttttgtagaaggtcgtatccatgggttttttatatttgaaaagtgttttcgatgtatcattgggggagattaaatgtctttgacagttgtccaactagaaataaagtcagcatcccatttgactccttacacagaagttcattctatactcattacagatgtaagaggttaagatggtagaggagaatgtagagtatttctgtgcctttaggttcaggaggtctttgataagcaggacaaggtccagaagccatgaagagagaatgacaggactgtgtagaagatttaaacctttttcatggcgtaagatactgtatgcaaagttaaaaggcatatgacaggctgagagatatcttaaacatacattagaaaggatatagcccttgaaaaagggctgttggaaagcagcaaggataaggtgcacagtcttgcagagcatgtcaacaaaatttattggatgaagaaattaaaatggttaaatagaagaagttctcaacctcactaatgatcagataagtgcagattgtaaaagtcctcatccccaccaacacaaaccagcagaaattttatgtgaatgtgaagtttggataatatccagtattgtcgcaggtgtgagaaaccgtattttcaaatattgagagggtaaattagaggaaagccattttagagggcaatgtggtgttacctgtcagcattttgaatataattaccctttgccacaattctacacctagtcagttatgttctcaaaaagcacaagtgcagaaatatagatgcataagcaaatgtgttgcagaattgtgaaaaatttggaaaaaatgtttagtgctattaaagttatgggttacttaagttacagaaaatcagtttagtagatcactgtgtagttacggaaaatgagatggatctctactcaaagatgtcttgcagtttatgaactgagatgtaacttcatgactaacatgatgacatcgttattaactacataaactttataaagcttaaaaaatgcattcat

SEQ ID NO: 202638 - DNA, 5859 bp, Homo sapiens
  Payload ID: 19961
  Gene Name: zinc finger protein 471
  Uniprot ID: Q9BX82
  ENST ID: ENST00000591537
  CDS Start-End: 127-870
gatggggggttccagcgtcgactcacggagtccttcggatgagagcgtctgggtgccagacgaggccggggccttgccctcccaagacactgttcttcaagagaaagaccagaagagaaggcaaaaatgaatgttgaagtagtaaaagtcatgccccaggacttagtgacattcaaggatgtggcaatagatttttcccaggaagaatggcaatggatgaaccctgctcagaagcgtttatacaggagtatgatgttggagaactatcagagcctggtatcacttggtctttgcatttctaagccatatgtgatctccttattggagcaagggagagagccttgggagatgacgagtgagatgacaagaagcccattctcagaattcatactggtgaaaaaccatatgcatgtgaggaatgtggaaaagccttcaagcaaaggcaacaccttgctcaacatcacagaacacatactggagagaaactctttgaatgtaaagaatgtaggaaagccttcaaacaaagtgaacaccttattcagcatcaaagaattcatactggagaaaaaccatataaatgtaaggaatgcagaaaagccttcagacagcctgcacaccttgctcagcatcagagaattcatactggagagaaaccctatgaatgtaaagaatgtggcaaagccttcagtgatggctcgtcttttgctcgacatcagagatgtcacactggcaaaagaccctatgaatgtattgagtgtgggaaggcttttaggtataacacatcttttattcgtcactggaggagttatcatactggagagaagccttttaattgcattgattgtgggaaagccttcagtgttcacataggacttattctgcataggagaattcatacaggagagaaaccttacaaatgtggtgtgtgtggaaaaaccttcagctcgggttcatcccgtactgtacatcagagaattcatacaggagagaaaccttatgaatgtgatatatgtgggaaagattttagccatcatgcatcactcactcagcatcaaagagtacattctggagagaaaccgtatgaatgcaaggaatgtgggaaagcctttaggcagaatgtacaccttgttagtcatttgagaattcatactggtgaaaaaccctatgaatgtaaagaatgtggaaaagcttttagaatcagttcacagctggctactcatcagagaattcatactggagagaagccttatgaatgtattgaatgtggaaatgctttcaaacagagatcacaccttgcccaacatcagaaaactcatacaggagagaaaccttatgagtgtaatgaatgcgggaaagccttcagccaaacttccaatcttactcaacatcaaagaattcatactggagagaaaccctataaatgtactgaatgtggaaaggcttttagtgatagctcatcctgtgctcagcatcaaagactccacactggccaaaggccctatcagtgttttgaatgtgggaaggcgttcagaagaaagttatccttaatttgtcatcaaagaagtcatactggagaagaaccttaagaatgtagtgcatgtggccaagcctttagttatcaccaatcccctactgttaatcagagatgtcccactggataaaaaacatataaatgtaagaaatgtagaaaaaccttcagccaggaggctggcaagatggccgaataggaacagctctgatctgcagttcccagtgagatcaacgcagaaggtgggtgctttctgtatttccagctgaggtacctggctcatctcattgggactggttagacagtgggtgcagcccacggagggtgagctgaagcagggtggggcgtaacctcacctgggaagtgcaaggagtcggggatctccctcccctagccaagggaagccatgagggactgtgccatgaggaatggtgcactccggcacagatactacgcttttcccatggtcttcgcaacccacagaccaggagatcccccttgggtgcctatgccaccaaggccctgggtttcaagcacaaaactgggcggccattcgggcagacaccgagctagctgtaggagtttttttgatagcccagtggcacctggaatgccagtgaaacagaaccgcttactcccttgttaagggggctgaagccggggagccaagtggttcccatgcccactgagcccagcaagctaagatccactggcttggaattctccctgccagcacagcagtctgaagtcaacctgggatgatcaagcttggtggggggaggggcgccaaccattaccaaagcttgaataggtggttttcccctcacagcgtaaacaaagccatggggaagttccagctgagcagagccctccacagctcagcaaagcctctgtagccagactgcctctctagattcctcctctctgggcagcgcatctttgaaaaaagtgcagataaaaccctcatctccctgggacaaagcacgtgggggaaaggggtggctgtgggcacagcttcagcagacttaaacattcctgcctgccagctctgaagagagcagcagttcttccagcacagcgcttgagctctgctaagggacagactgcctcctcaagtgggtccctgacccccatgcctcctgacggggagacacctcccagcaggggtccacagacacctcatacaggagagctctggctggcatctggtgggtgcccctctgggacaaagcttccagaggaaggaacaggcagcaatctttgctgttctgcagcctccaccggtgatacccaggcagatatggtctggagtggacctccagcaaactccagcagacctgcagccgaggggcctcactgttagaaggaaaactaacaggaatataatcaacatcaacaaaggacatccacacagaaaccccatctgaaggttaccagcatcaaagaccaaaggtagataaattcacgaagatgaggagaaaccagtgcaaaaagcctgaaaattccaaaaaccagaatgcctcttctcctccaaaggatcacaactccttgccggcaagggaacaaaactggatagagaatgagtttgacaaattgacagaagtaggcttcagaaggtgggaaataacaaactcctctgagctaaaggagcatgttctaacccaatgcaaggaagctaagaaccttgaaaaaaggttagaggaattgctaactagaataaccagtttagagaagaacataaatgacctgatggagctgaaaaacacagcatgagaacttcgtgaagcatacagaagaaaaaccttcagccagattgaatgctttacagggaagaattcatactgcagagcggtcttaacaatgtaaagaatgtgcaaatgtcctcagacaagatgcacaccttgctcattagtgagttcatttcaggcagccagctcttcctcacccactacatcaccaagtcctgtggatatatctgctaaatatttttggaatttatccacttcttttggttccccagtccaaaacacagtcatttcacctggactatttcaatcattacacaggtgtccaaccttttgtcttccctgggccacattggaagaagaaaaattgtcttgtgccacacatacaatacactaacattaacaatagctgatgagctaagaaaaaaaaaaagtctgtgcatagttttagtgatacaccacctccgataagcaaaaaagtcctcacattcaatgggttgcatacccatgaattctaaaacttcatcctcttttgtccctttcgagttaacattacagccacagtgacctttcaaaaatgcaaattaagttactcttaaaactctagttaaaatacttgatgtacataaagtgcttagcaaaatgaccaactcatactaagtgcttagtaaatgttagataagtattctccagaattgatgtaaattatttttaaacagtgcattcttgaaagcagtatggcagtcataaaaattttggaaccaaaacagtatctttttttaagctaaaaaaaaagttttaaatggtgtctttctatgttgcccagggtggtctcaaactcctgtgctcaagtgaccctcccacctcattctcaagtggctgcaattacaggcaaccagcctgacttaaaacagtatcttaaggtagatggtgattagcacatgtagtatgcttaacatttaatattataataagacatcacagcggctgtctcatgattaaggctgtgttcccttgttggtgaggaaattaattatgacttgataaatagaacatgttttaagaagtggctatatagctctggataaaacgaacaaaagaattagaattcctgcggggaatatatacaagactttatttagtcaagtaaaaaaaaatcactaatgtttaactgaagaaagagaaattgaataatatagttctatttcaacatgtgggttcacagatttattctaaccttccaagtaaagttgttccactagtaaagttgttctggagtatattttttttaaaaaaaacacttaaaatgttccacttctttcatgaggctaagtcaactctgatatcaaaccaaggggaaagaaatgaaattataggtgagtttacttagttatatacaaaaggaaattattagcctctgctgatggagaacagaggctgtgaataaatggagatccataacatgatcctacatgaatgtttcaatattgtaatcctgtaagttacttttacattgacagttctgaaattcatgttgagtgttaattaggcaggaatcagaagggaggttttgtagaaggtcgtatccatgggttttttatatttgaaaagtgttttcgatgtatcattgggggagattaaatgtctttgacagttgtccaactagaaataaagtcagcatcccatttgactccttacacagaagttcattctatactcattacagatgtaagaggttaagatggtagaggagaatgtagagtatttctgtgcctttaggttcaggaggtctttgataagcaggacaaggtccagaagccatgaagagagaatgacaggactgtgtagaagatttaaacctttttcatggcgtaagatactgtatgcaaagttaaaaggcatatgacaggctgagagatatcttaaacatacattagaaaggatatagcccttgaaaaagggctgttggaaagcagcaaggataaggtgcacagtcttgcagagcatgtcaacaaaatttattggatgaagaaattaaaatggttaaatagaagaagttctcaacctcactaatgatcagataagtgcagattgtaaaagtcctcatccccaccaacacaaaccagcagaaattttatgtgaatgtgaagtttggataatatccagtattgtcgcaggtgtgagaaaccgtattttcaaatattgagagggtaaattagaggaaagccattttagagggcaatgtggtgttacctgtcagcattttgaatataattaccctttgccacaattctacacctagtcagttatgttctcaaaaagcacaagtgcagaaatatagatgcataagcaaatgtgttgcagaattgtgaaaaatttggaaaaaatgtttagtgctattaaagttatgggttacttaagttacagaaaatcagtttagtagatcactgtgtagttacggaaaatgagatggatctctactcaaagatgtcttgcagtttatgaactgagatgtaacttcatgactaacatgatgacatcgttattaactacataaactttataaagcttaaaaaatgcattcat

SEQ ID NO: 202639 - DNA, 564 bp, Homo sapiens
  Payload ID: 19961
  Gene Name: zinc finger protein 471
  ENST ID: ENST00000591759
  CDS Start-End: 335-564
cctccgtgtgaccatgaaacctgtgttagtgtttgtatgtcaccctgtatacccataattgtggccctgtatgactgctgtgtatggagagactacttggaagattgataggattggattctttatgagtgtggctgtttggaattgtgtgttgccgggataggaaatgtggaatagaattcctgtccccagtccaagggtttcagtaagaagcaaagctggggtgactgaagctcctaactgaagcaggagacaccctcacttctgtgtgacaggaggccttgccctcccaagacactgttcttcaagagaaagaccagaagagaaggcaaaaatgaatgttgaagtagtaaaagtcatgccccaggacttagtgacattcaaggatgtggcaatagatttttcccaggaagaatggcaatggatgaaccctgctcagaagcgtttatacaggagtatgatgttggagaactatcagagcctggtatcacttggtctttgcatttctaagccatatgtgatctccttattggagcaagggagagagccttgggagatgacgag

SEQ ID NO: 202640 - DNA, 4688 bp, Homo sapiens
  Payload ID: 19962
  Gene Name: zinc finger protein 473
  Uniprot ID: Q8WTR7
  ENST ID: ENST00000270617
  CDS Start-End: 360-2975
gggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgagggagactcacattgggacttgtcctcctcctcctggacattttgggggctcgtcagcatggacagcgagtcagccatgggtggaagggaggctttctcacagctcccttgtgcttcccacagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgattagaaagtttgtgcgcatgtttttcattataacaatgaaaacacaaaagtggagaagctgtacaacgtcaggattcagaggtaggctctggagccagtctaccttgagttaaatcccacctctgccatctactacctaagtgaccttgggaaggtcagaaaaatctctcagggcctcggtgtccttatctgtaaaatgggcatcacctacctcagagggcttttctgaggattaaataaataaatgtgaagcacttagaactgatggccagcacatgagggctcaccaagtgtaagccacaaatacacatcagctatagcacaaatatacttgtgttacaagaaaggaattagtaatctgtgtttactgtagttaatgttcttacaatgtatcgcttttaatttaagttttccttttttacagtttttctccagcactttactcttcttaagtgcctggccttttttgtccctttatctctcctggtttttttcttaagccccagaaagccaaaaagaacatgtaaactcttcacctcaactagctacaaccttccactcctaacctcccaagcttctcacttaaagaggactccctatcccacaaacacatgctccctcttcctatgaccttcctccatttaacagtgttggttatgcaataagacacccaatttttcatgggagttgacaccaaaacacagctggattccatcaggaaagctgcattgatcagggtgttaaccgcatatgaaacaacccatatggaagacatacttaggggtcaaacctgtggtgtgtggaagtgaccactgggatgtcatcattcaccatttatccaggatggccgctcaccaggcaatttgctaggctcgggggcgggtagtatccatacactatgcactactgctctgaagcttctggaatcagaaatgaacccattttcatcgacgattgctgttagttgacaagtgacatcttgaaaatgccacattccctcatgtcacaggaagttctgggatcaccaaggattgttggagagtccagtgagatggaaccacacaaccagttccctaccagtgtcttgtcagctctgggtgtttgttccctgccactaagtggctcagtcacacctttgctgaaacacagtagtcttatgaaaagcactggacacatactttgaatacctttcatattttaggtgctgaaaatggtgagggagtgagtgctctgcacccttgggcttttcaactcttgcacctggagttctgctggttaagtttgttaaacttagttgaaactgggaacctgttggctaaccattggggccttacactgtttttcaaatggttgcaacatttaacttctcgcacatggttcccgtcctctggagctctgtcttgtcggggagatgggcatgttgtataccaaaagagtgtacaaagtgttgcagggctgtgacacaatagggactctatggaaaactggcagccattgggtgtgggggcagtctgtaaatcagtcacctgtgttgctgcaggccaaggtagaaacgccctccgtgtgtgcatatttgttggttctctgattaaagttttgagtct

SEQ ID NO: 202641 - DNA, 4715 bp, Homo sapiens
  Payload ID: 19962
  Gene Name: zinc finger protein 473
  Uniprot ID: Q8WTR7
  ENST ID: ENST00000391821
  CDS Start-End: 387-3002
aattagatgattctttaacaaggtaaaaatctggactacaaactgatgccgcctggtcctgattctctttctactctactcccacagtgctaaggctgaagaagcaggaggagatgggaaggcgaaagaagtcgcccgcacagccctctgggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgattagaaagtttgtgcgcatgtttttcattataacaatgaaaacacaaaagtggagaagctgtacaacgtcaggattcagaggtaggctctggagccagtctaccttgagttaaatcccacctctgccatctactacctaagtgaccttgggaaggtcagaaaaatctctcagggcctcggtgtccttatctgtaaaatgggcatcacctacctcagagggcttttctgaggattaaataaataaatgtgaagcacttagaactgatggccagcacatgagggctcaccaagtgtaagccacaaatacacatcagctatagcacaaatatacttgtgttacaagaaaggaattagtaatctgtgtttactgtagttaatgttcttacaatgtatcgcttttaatttaagttttccttttttacagtttttctccagcactttactcttcttaagtgcctggccttttttgtccctttatctctcctggtttttttcttaagccccagaaagccaaaaagaacatgtaaactcttcacctcaactagctacaaccttccactcctaacctcccaagcttctcacttaaagaggactccctatcccacaaacacatgctccctcttcctatgaccttcctccatttaacagtgttggttatgcaataagacacccaatttttcatgggagttgacaccaaaacacagctggattccatcaggaaagctgcattgatcagggtgttaaccgcatatgaaacaacccatatggaagacatacttaggggtcaaacctgtggtgtgtggaagtgaccactgggatgtcatcattcaccatttatccaggatggccgctcaccaggcaatttgctaggctcgggggcgggtagtatccatacactatgcactactgctctgaagcttctggaatcagaaatgaacccattttcatcgacgattgctgttagttgacaagtgacatcttgaaaatgccacattccctcatgtcacaggaagttctgggatcaccaaggattgttggagagtccagtgagatggaaccacacaaccagttccctaccagtgtcttgtcagctctgggtgtttgttccctgccactaagtggctcagtcacacctttgctgaaacacagtagtcttatgaaaagcactggacacatactttgaatacctttcatattttaggtgctgaaaatggtgagggagtgagtgctctgcacccttgggcttttcaactcttgcacctggagttctgctggttaagtttgttaaacttagttgaaactgggaacctgttggctaaccattggggccttacactgtttttcaaatggttgcaacatttaacttctcgcacatggttcccgtcctctggagctctgtcttgtcggggagatgggcatgttgtataccaaaagagtgtacaaagtgttgcagggctgtgacacaatagggactctatggaaaactggcagccattgggtgtgggggcagtctgtaaatcagtcacctgtgttgctgcaggccaaggtagaaacgccctccgtgtgtgcatatttgttggttctctgattaaagttttgagtct

SEQ ID NO: 202642 - DNA, 2833 bp, Homo sapiens
  Payload ID: 19962
  Gene Name: zinc finger protein 473
  ENST ID: ENST00000445728
  CDS Start-End: 146-2725
agagaagcttctcgcgcacaggaagtcgctgcgaggaggcgcgtgtgcggggagttgaatctcccgctcccttgaggctggggttgcgtctgttgacgcggccgactacaatcccgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattg

SEQ ID NO: 202643 - DNA, 558 bp, Homo sapiens
  Payload ID: 19962
  Gene Name: zinc finger protein 473
  ENST ID: ENST00000599155
  CDS Start-End: 252-558
aatcccgaggtacggagacgctggggctgagggacttgcgggctcggtccttcctgagagggagactcacattgggacttgtcctcctcctcctggacattttgggggctcgtcagcatggacagcgagtcagccatgggtggaagggaggctttctcacagctcccttgtgcttcccacagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttat

SEQ ID NO: 202644 - DNA, 605 bp, Homo sapiens
  Payload ID: 19962
  Gene Name: zinc finger protein 473
  ENST ID: ENST00000598809
  CDS Start-End: 382-605
agaaacccgtcacaacgcgtttccatggcaacctaccgcttgctcttcggaaaaggttaacactccctgacttctagtaaagtgctaaggctgaagaagcaggaggagatgggaaggcgaaagaagtcgcccgcacagccctctgggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccc

SEQ ID NO: 202645 - DNA, 603 bp, Homo sapiens
  Payload ID: 19962
  Gene Name: zinc finger protein 473
  ENST ID: ENST00000601364
  CDS Start-End: 153-386
gaggcgcgtgtgcggggagttgaatctcccgctcccttgaggctggggttgcgtctgttgacgcggccgactacaatcccgagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctggtttctaaggtgataggagataagcctggagctgctcgtggtcaccttgccaccatggggggagaacctgccagaaaatgaaactaaccaaaaaggaagctgagctaagaggagtgaccagattactgacatgtctcttaaacacctggatccatctgttcctgaaggcaaaactgttcaattacataggctaataaattccctttcttccttaaacaaacagaa

SEQ ID NO: 202646 - DNA, 475 bp, Homo sapiens
  Payload ID: 19962
  Gene Name: zinc finger protein 473
  ENST ID: ENST00000594968
  CDS Start-End: 93-287
gttgaatctcccgctcccttgaggctggggttgcgtctgttgacgcggccgactacaatcccgaggaatttgtgaccctcaaggatgtcggcatggacttcaccttgggagactgggagcagctcgggctggaacagggggacacgttctgggacacagcgttggacaattgccaggacctcttcctgctgggcttttcccaggagagcagccagcctgctgtgtcgccctcttctgcacaccagtgtcacacagtgagacagcagcagggcccagactccagctaagaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctg

SEQ ID NO: 202647 - DNA, 4828 bp, Homo sapiens
  Payload ID: 19962
  Gene Name: zinc finger protein 473
  Uniprot ID: Q8WTR7
  ENST ID: ENST00000595661
  CDS Start-End: 496-3111
gtcacaacgcgtttccatggcaacctaccgcttgctcttcggaaaaggttaacactccctgacttctagtaaagtgctaaggctgaagaagcaggaggagatgggaaggcgaaagaagtcgcccgcacagccctctgggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgagggagactcacattgggacttgtcctcctcctcctggacattttgggggctcgtcagcatggacagcgagtcagccatgggtggaagggaggctttctcacagctcccttgtgcttcccacagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgattagaaagtttgtgcgcatgtttttcattataacaatgaaaacacaaaagtggagaagctgtacaacgtcaggattcagaggtaggctctggagccagtctaccttgagttaaatcccacctctgccatctactacctaagtgaccttgggaaggtcagaaaaatctctcagggcctcggtgtccttatctgtaaaatgggcatcacctacctcagagggcttttctgaggattaaataaataaatgtgaagcacttagaactgatggccagcacatgagggctcaccaagtgtaagccacaaatacacatcagctatagcacaaatatacttgtgttacaagaaaggaattagtaatctgtgtttactgtagttaatgttcttacaatgtatcgcttttaatttaagttttccttttttacagtttttctccagcactttactcttcttaagtgcctggccttttttgtccctttatctctcctggtttttttcttaagccccagaaagccaaaaagaacatgtaaactcttcacctcaactagctacaaccttccactcctaacctcccaagcttctcacttaaagaggactccctatcccacaaacacatgctccctcttcctatgaccttcctccatttaacagtgttggttatgcaataagacacccaatttttcatgggagttgacaccaaaacacagctggattccatcaggaaagctgcattgatcagggtgttaaccgcatatgaaacaacccatatggaagacatacttaggggtcaaacctgtggtgtgtggaagtgaccactgggatgtcatcattcaccatttatccaggatggccgctcaccaggcaatttgctaggctcgggggcgggtagtatccatacactatgcactactgctctgaagcttctggaatcagaaatgaacccattttcatcgacgattgctgttagttgacaagtgacatcttgaaaatgccacattccctcatgtcacaggaagttctgggatcaccaaggattgttggagagtccagtgagatggaaccacacaaccagttccctaccagtgtcttgtcagctctgggtgtttgttccctgccactaagtggctcagtcacacctttgctgaaacacagtagtcttatgaaaagcactggacacatactttgaatacctttcatattttaggtgctgaaaatggtgagggagtgagtgctctgcacccttgggcttttcaactcttgcacctggagttctgctggttaagtttgttaaacttagttgaaactgggaacctgttggctaaccattggggccttacactgtttttcaaatggttgcaacatttaacttctcgcacatggttcccgtcctctggagctctgtcttgtcggggagatgggcatgttgtataccaaaagagtgtacaaagtgttgcagggctgtgacacaatagggactctatggaaaactggcagccattgggtgtgggggcagtctgtaaatcagtcacctgtgttgctgcaggccaaggtagaaacgccctccgtgtgtgcatatttgttggttctctgattaaagttttgagtctaaaa

SEQ ID NO: 202648 - DNA, 1964 bp, Homo sapiens
  Payload ID: 19963
  Gene Name: zinc finger protein 474
  Uniprot ID: Q6S9Z5
  ENST ID: ENST00000296600
  CDS Start-End: 384-1478
aggcaacaaagactgcggttcctgttactcagcagcctcaaaaactcacaccagctcctgcaaggaatgtgaatcttggagctcccagctattctgttcctgtttctgtcagctccttccctgaaaactcagaggtgctcagcatgccatgctaaaaggcaaaataaaaagatcttggagacatctcagctttaatgaggactttccaacattccagactgccgtcctgcaatgaagctctgagtcacggtctgtgaggctaaggtactggcaacggtgtgaaccccaggacaactaacctcactaaccttcactctaagcagaagcccaaagtgagtctggcctgaaatcagagcaagcactacagaaagacatctttgttaatggaaagaggaaagaagaaaagaatttccaataagttacaacaaacttttcaccattctaaagaacccactttccttatcaaccaagctgggcttctctctagtgactcctattctagcctttccccagaaacagagagtgttaatcctggtgaaaatataaagacagacactcagaaaaagagacctgggactgtgatactatcaaaactgtcaagtagaagaattatatcggaaagccagcttagcccccctgtgatcccggcccgcaggcctggattccgggtatgctatatctgtggccgagaatttgggtcccagtcaattgccattcatgaaccccagtgcttgcagaagtggcatattgaaaacagcaagttgcccaagcatttgaggaggccagaaccctccaaaccacagtctctcagcagcagtgggtcctacagtcttcaggcaactaacgaggctgcatttcagagtgcccaggctcagctgctgccctgtgaatcctgtggccgcacattcttgccagatcatcttcttgttcatcacagaagctgcaagccaaagggtgagggtcccagagcaccacactcaaacagttctgatcatcttactggcctcaagaaagcttgtagtggaaccccagcccgaccaaggactgttatctgctacatatgtggtaaggaatttggcaccctgtcccttcctattcatgagcccaaatgcctggaaaagtggaaaatggaaaatgaccggctccctgtggagctccaccagccactcccacagaagcctcagccccttccgaatgcacagtccagccaagcgggaccaaatcaagctcagcttgtgttctgcccacattgtagccgaatctttacctcagaccgcctcctggtacaccagagaagttgtaaaactcatccttatgggccaaaatatcagaatttgaatttagggagtaaaggaggcctaaaagagtacactaattccaagcagcaaaggaacagggcagcacccagtgtaactgataaggtaattcatgccacacaagacgcattaggtgaacctggtggtgccctctgcctgtaggggaacaagagaaaactatccccagaatcagccacctcagcccctagtattttttctatcaatgccttgtatcagcctcaaagcagcctgttcaagttaactccctgttgaactccagggcctatacctctcttggctgaatagatataagaacatccttgcctgatgggttcatattcctcttcaattctgctgtctaaaagaagaagagatggacttctttcttccctgatccctgatacaaataatccctgggagagacagtaatttgaaaatgagtcattaatgctgtgtctacattacagagatataattcccattccaacagccaatatttattgtcggtttattttagtcatctaccttaggaattcatttttggcaatgctgggttatgctgagtttatcttactaaaatagaatctgtgtcaaaaacccccaatgactttagcaacaattaaacactgaagcacttgcaaaaataca

SEQ ID NO: 202649 - DNA, 546 bp, Homo sapiens
  Payload ID: 19963
  Gene Name: zinc finger protein 474
  ENST ID: ENST00000504912
  CDS Start-End: 358-546
acaccagctcctgcaaggaatgtgaatcttggagctcccagctattctgttcctgtttctgtcagctccttccctgaaaactcagaggtgctcagcatgccatgctaaaaggcaaaataaaaaggtaaagaacaaatgtcacaagatcttggagacatctcagctttaatgaggactttccaacattccagactgccgtcctgcaatgaagctctgagtcacggtctgtgaggctaaggtactggcaacggtgtgaaccccaggacaactaacctcactaaccttcactctaagcagaagcccaaagtgagtctggcctgaaatcagagcaagcactacagaaagacatctttgttaatggaaagaggaaagaagaaaagaatttccaataagttacaacaaacttttcaccattctaaagaacccactttccttatcaaccaagctgggcttctctctagtgactcctattctagcctttccccagaaacagagagtgttaatcctggtgaaaatataaagacagacactcagaaaaagagacct

SEQ ID NO: 202650 - DNA, 572 bp, Homo sapiens
  Payload ID: 19963
  Gene Name: zinc finger protein 474
  ENST ID: ENST00000505843
  CDS Start-End: 464-572
gctcctgcaaggaatgtgaatcttggagctcccagctattctgttcctgtttctgtcagctccttccctgaaaactcagaggtgctcagcatgccatgctaaaaggcaaaataaaaagagaatggaaaaatggcatcatgttgataaaaggtgatgccttccaggacattctgtaaatgtcctatgtgcagatatggtcaaaacgaataattcaggccaactgagtgaacatttctccagagatgcttgagatcttggagacatctcagctttaatgaggactttccaacattccagactgccgtcctgcaatgaagctctgagtcacggtctgtgaggctaaggtactggcaacggtgtgaaccccaggacaactaacctcactaaccttcactctaagcagaagcccaaagtgagtctggcctgaaatcagagcaagcactacagaaagacatctttgttaatggaaagaggaaagaagaaaagaatttccaataagttacaacaaacttttcaccattctaaagaacccactttccttatcaaccaagctgggcttctctctagtgact

SEQ ID NO: 202651 - DNA, 1811 bp, Homo sapiens
  Payload ID: 19964
  Gene Name: zinc finger protein 479
  Uniprot ID: Q96JC4
  ENST ID: ENST00000319636
  CDS Start-End: 18-1592
caggtatctgcagatttatggctaaaagaccaggaccccctggaagccgagaaatgggactgttgacattcagagacatagctatagaattctctctggaggaatggcaatgcctggattgtgctcagcggaatttatatagagatgtgatgttagagaactacagaaacctggtctccctgggtattgctgtctctaagccagacttgatcacctgtctggagcaaaataaagagtcccagaatataaagagaaatgagatggtagccaaacacccagttacgcgttcccatttcacccaagaccttcagccagagcagggcatcaaagattcactccaaaaagtaataccaagaacatatggaaaatgtggacatgagaaattacaatttaaaaaatgctgtaaaagtgtgggtgaatatgaggtgcacaagggaggttatagtgaagttaaccaatgtttgtcaactacccaaaacaaaatatttcagactcataaatatgtcaaagtctttggtaaattttcaaattccaatagagataaaacaagatatactggaaataaacatttcaaatgtaacaaatatggcaaatcattttgcatgctttcacacctaaatcaacatcaggtaattcatactagggagaagtcctacaaatgcaaagaatgtggcaaatcctttaactgctcctcaaaccatactacacataaaataattcatactggagagaaaccatatagatgtgaggaatgtggcaaagcctttagctggtctgcaaaccttactagacataagagaactcatactggagagaaaccctacacgtgtgaagaatgtggccaagcctttaggcgctcctcagcacttactaaccacaagagaattcatactggagagagaccctacaaatgtgaagaatgtggcaaagcctttagcgtatcctcaaccctcactgaccacaagagaattcatactggagagaaaccctgcaggtgtgaggaatgtggcaaagcctttagctggtcctcaaaccttactagacataagagaattcatactagagagaaaccctatgcctgtgaagaatgtggccaagcctttagcttatcctcgaaccttatgagacataggagaattcatactggagagaaaccctacacatgtgaagaatgtggccaagactttaggcgctcctcagcacttactatccacaagagaattcatactggagagagaccctacaaatgtgaagagtgtggcaaagtctttagcttatcctcaaccctcactgaccacaagagaattcatactggagagagaccctacaaatgtgaagaatgtggcaaagcctttagcttatcctcaaccctcactgaccacaagagaattcatactggagagagaccctacacatgtgaagaatgtggcaaagcctttaattgctcctcaacccttatgcaacataagagaattcatactggagagaaaccctacaaatgtgaagaatgtgagcaagcttttaagtggcattcaagtcttgctaaacataagataattcacactggagagaaaccctacaaatgtgaataatatggcaaagtccaccctcaggccttataatacataaaataatttacactggaaaaaaacactacaaatgtagagaatgtggccaagcctttaaccagttccaaaccttaattgaatgtaagagaattcatattggacagaaattttataaatgtaaaaaaatgtaacaaagcctttaaccaaccctcaaaccttaataaacctaagagaatttatttt

SEQ ID NO: 202652 - DNA, 2072 bp, Homo sapiens
  Payload ID: 19964
  Gene Name: zinc finger protein 479
  Uniprot ID: Q96JC4
  ENST ID: ENST00000331162
  CDS Start-End: 272-1846
ggcaggaaagaagagtcacatcacgtaggtgatgggcctagagatatttcacaatgccttctgtaattagaacccagaaaaaagagttatatcatttgggttaaaggtcttgtgatatgtcacaatcccaactaagggcaggacccaggcagaaaaggagagtcacttcctttgatgattggtccagagatacattacaatttcccctgaggacagctctcatgcagaagaggaactgaatatactgcatggcccaggtatctgcagatttatggctaaaagaccaggaccccctggaagccgagaaatgggactgttgacattcagagacatagctatagaattctctctggaggaatggcaatgcctggattgtgctcagcggaatttatatagagatgtgatgttagagaactacagaaacctggtctccctgggtattgctgtctctaagccagacttgatcacctgtctggagcaaaataaagagtcccagaatataaagagaaatgagatggtagccaaacacccagttacgcgttcccatttcacccaagaccttcagccagagcagggcatcaaagattcactccaaaaagtaataccaagaacatatggaaaatgtggacatgagaaattacaatttaaaaaatgctgtaaaagtgtgggtgaatatgaggtgcacaagggaggttatagtgaagttaaccaatgtttgtcaactacccaaaacaaaatatttcagactcataaatatgtcaaagtctttggtaaattttcaaattccaatagagataaaacaagatatactggaaataaacatttcaaatgtaacaaatatggcaaatcattttgcatgctttcacacctaaatcaacatcaggtaattcatactagggagaagtcctacaaatgcaaagaatgtggcaaatcctttaactgctcctcaaaccatactacacataaaataattcatactggagagaaaccatatagatgtgaggaatgtggcaaagcctttagctggtctgcaaaccttactagacataagagaactcatactggagagaaaccctacacgtgtgaagaatgtggccaagcctttaggcgctcctcagcacttactaaccacaagagaattcatactggagagagaccctacaaatgtgaagaatgtggcaaagcctttagcgtatcctcaaccctcactgaccacaagagaattcatactggagagaaaccctgcaggtgtgaggaatgtggcaaagcctttagctggtcctcaaaccttactagacataagagaattcatactagagagaaaccctatgcctgtgaagaatgtggccaagcctttagcttatcctcgaaccttatgagacataggagaattcatactggagagaaaccctacacatgtgaagaatgtggccaagactttaggcgctcctcagcacttactatccacaagagaattcatactggagagagaccctacaaatgtgaagagtgtggcaaagtctttagcttatcctcaaccctcactgaccacaagagaattcatactggagagagaccctacaaatgtgaagaatgtggcaaagcctttagcttatcctcaaccctcactgaccacaagagaattcatactggagagagaccctacacatgtgaagaatgtggcaaagcctttaattgctcctcaacccttatgcaacataagagaattcatactggagagaaaccctacaaatgtgaagaatgtgagcaagcttttaagtggcattcaagtcttgctaaacataagataattcacactggagagaaaccctacaaatgtgaataatatggcaaagtccaccctcaggccttataatacataaaataatttacactggaaaaaaacactacaaatgtagagaatgtggccaagcctttaaccagttccaaaccttaattgaatgtaagagaattcatattggacagaaattttataaatgtaaaaaaatgtaacaaagcctttaaccaaccctcaaaccttaataaacctaagagaatttattttaaaaaaa

SEQ ID NO: 202653 - DNA, 1239 bp, Homo sapiens
  Payload ID: 19964
  Gene Name: zinc finger protein 479
  ENST ID: ENST00000620639
  CDS Start-End: 1-1239
atggctaaaagaccaggaccccctggaagccgagaaatgggactgttgacattcagagacatagctatagaattctctctggaggaatggcaatgcctggattgtgctcagcggaatttatatagagatgtgatgttagagaactacagaaacctggtctccctgggtattgctgtctctaagccagacttgatcacctgtctggagcaaaataaagagtcccagaatataaagagaaatgagatggtagccaaacacccagttacgcgttcccatttcacccaagaccttcagccagagcagggcatcaaagattcactccaaaaagtaataccaagaacatatggaaaatgtggacatgagaaattacaatttaaaaaatgctgtaaaagtgtgggtgaatatgaggtgcacaagggaggttatagtgaagttaaccaatgtttgtcaactacccaaaacaaaatatttcagactcataaatatgtcaaagtctttggtaaattttcaaattccaatagagataaaacaagatatactggaaataaacatttcaaatgtaacaaatatggcaaatcattttgcatgctttcacacctaaatcaacatcaggtaattcatactagggagaagtcctacaaatgcaaagaatgtggcaaatcctttaactgctcctcaaaccatactacacataaaagaattcatactggagagaaaccctgcaggtgtgaggaatgtggcaaagcctttagctggtcctcaaaccttactagacataagagaattcatactggagagaaaccctacacatgtgaagaatgtggccaagactttaggcgctcctcagcacttactatccacaagagaattcatactggagagagaccctacaaatgtgaagagtgtggcaaagtctttagcttatcctcaaccctcactgaccacaagagaattcatactggagagagaccctacaaatgtgaagaatgtggcaaagcctttagcttatcctcaaccctcactgaccacaagagaattcatactggagagagaccctacacatgtgaagaatgtggcaaagcctttaattgctcctcaacccttatgcaacataagagaattcatactggagagaaaccctacaaatgtgaagaatgtgagcaagcttttaagtggcattcaagtcttgctaaacataagataattcacactggagagaaaccctacaaatgtgaataa

SEQ ID NO: 202654 - DNA, 3234 bp, Homo sapiens
  Payload ID: 19965
  Gene Name: zinc finger protein 48
  Uniprot ID: Q96MX3
  ENST ID: ENST00000320159
  CDS Start-End: 377-2233
tccccgcccccggtggccgcccccgggacgcctgggtccgagcccgctcccggcttggcgcggagcctgcatcccggagccgctggcggctcgggcgcctgcaccccgctgaggagctccggagggcgccggggtggcggagccggaggcggccggcaaggtgagagcggcggctgcgcgctgggaggagcagcaggtgcaggggcggccggcggcgcgggcagggggcaccgggagccgcgcccgtacctgggacccgacgccgcccggtgcccgcgctggccggcagagggcagcggcagggcgccgcgggccacacatggctgcgtgaccgcgggatgctgtctgtccccttgctcagggcggcgtgccggcgatggagcgcgcggtagagccttggggcccagatctccaccgcccggaggagagggagccacagagaggcgcccgcacaggtctagggagtgagaacgtgatttctcagccgaatgagtttgaacataccccacaggaagatgacttggggttcaaggaagaagatttggctccagatcatgaagtaggaaatgcctctctcaaacctgaaggcatccagaactgggatgacttatgggtccagagagagggtctaggaaagcctcagcctcgggacagaggcccccggctcctgggtgaaccacgctggggccaggctagtagtgatcgggccgctgtgtgtggtgagtgtggcaaaagcttcaggcagatgtcagatctggtgaaacaccagcggacccacacaggggagaaaccctacaagtgtggggtctgtggcaagggctttggggatagctctgcccggatcaaacaccagcggactcatagtggggagaagccctatagagcccggccaccagcccagggtcccccaaagattcctcggtcccggatccctgctggtgagcgccccactatctgtggtgaatgtggcaagagcttccggcagagttctgacctggtgaaacaccagcggacacacactggtgagaagccctacaagtgtggcatatgtggcaagggctttggcgacagttccgcccgcatcaagcaccagcggacacaccggggggagcagcccccccgaccagtggtgccccgacggcagccatctcgggcagccacggcagctacccagggaccgaaggcccaggacaagccatatatctgcactgattgcggcaagaggtttgtgctcagctgcagcctcctgagtcaccagcgtagtcacttggggcccaagccctttggctgtgatgtgtgtggaaaggagtttgcccggggatccgacctggtgaagcacctgcgggtgcacacgggtgagaagccctacctctgcccagagtgcggcaaaggtttcgcggacagctccgcccgagtcaaacacctccgcacccacagtggcgagaggccccatgcctgcccggaatgcgaccgtaccttcagcctcagctccacccttcttcgccaccgcctcactcacatggagccccaggacttcagcttcccaggctatcccctacccgctctgatccccagcccacccccacctcctctgggcaccagccccccgctgacacctcgaagtccctcacactcgggtgagccttttggcctgcctggcttggagccagagcctgggggcccacaggctggggagccacccccaccactggcgggcgacaagccccacaagtgccctgagtgtggcaagggcttccgccgaagctctgacctggtgaaacaccatcgtgtgcacacaggggagaaaccctacctctgtcctgaatgcggcaagggttttgctgacagctcagcccgagtcaagcacctccgcacccaccgtggtgaacgggcccggccaccaccaccatccactctgctgcggccacataacccacctggcccagtacccatggcccctcgaccccgagttcgggcccagccttctggacccagccagccccacgtgtgtggcttctgtgggaaggagttcccccggagctcagatctggtcaaacacaggcgtacacacacgggggagaagccatacaagtgtgcagagtgtggcaagggttttggtgacagttctgcccgcatcaagcaccagcgtgggcacctggtcctgacgccctttgggataggggatggtagggcaaggcccctcaagcaggaggcagcaacaggactggaatgacgcggtccagggagggcggaggcccaggagaccaaagggaggggctctgccgcttagcagagaagaaagggcctgggaggtggtgggagggagaaggaagggaagaaaggggaggaagaatagatagaaatagggattggagacagtaaccttgaagctcaggaaactgtcctggctgggctgagtcaggaccttgccaggacgggctgtacccctggcttctagaagactgcctagcacacagtaggcattcaatacttgttgaataaataaactggctttcacctaaggactcaaccctaaattcctgctgcctcatctgttaagaactgacactttccccttgctgggcaggtagtacacacctgtaatcccagcagtttgggaggctgaggtgggagaatcacttgagcccaaaagtttgaggctgcagtgagctgattgcaccactgatgcctcccaaccttgctctgggagaccaatgcctgaaccagggtttgtttaccttctgagctgcagagatggggcttctggaatttaaggtaacaggatgaggcaggggtatcttgatcatccggatggggcaaatactgctgtgtggcatggtggtacccacccctatggaggggcactcttggacagagcccagacctttgtgccctggagggagccaacccaccctgacacggagacactggcagaatagaccagagacagaaggtgctctcatggtatccagcctggatgccaagcccaagtcctggtggatagcagaggccagctgtttgggaaaagggcaggatgctctgaggcctggcagccacatttccatgtgtctttttaccaataaacggcttctcttctgaggcttggacagtgtgtgtgtacacacaggcatgaaaaaggtggagaggggtctctgcgcgcaaaactcagactgtaaattttgtgtgcttcccttgctctctgagcccattaaataaagaggttgtcttggcgta

SEQ ID NO: 202655 - DNA, 430 bp, Homo sapiens
  Payload ID: 19965
  Gene Name: zinc finger protein 48
  ENST ID: ENST00000495929
  CDS Start-End: 100-430
tttttccgcaaggaaggagaaggctcgcgtggccgcgggaagctcagtttttattgaagacagagtctgggagaagaagggggactccggaagacagtgatgcggtcggagtggctggcgctgtcggccggccggggaggtcggcgcgggtggctggagacacacagccacaattacgaagagcctcgggcctcaccacccagctgcagcccaggaggcacacggttaataccaccgagttcgggccgccggcctcggcttagagtagcccctgggccgcacgctgccgcccgccggccacagagctaccgccgacgcgggcgacccccacaggcccgcagctcctccaaggtcctagagcggctccgtgcggccccgcgcttccgcttcccgtccccgcccccggtggccgcccccgggacgcctgggt

SEQ ID NO: 202656 - DNA, 912 bp, Homo sapiens
  Payload ID: 19965
  Gene Name: zinc finger protein 48
  ENST ID: ENST00000524644
  CDS Start-End: 483-912
tttctttgtctctcccaggtcggagtggctggcgctgtcggccggccggggaggtcggcgcgggtggctggagacacacagccacaattacgaagagcctcgggcctcaccacccagctgcagcccaggaggcacacggttaataccaccgagttcgggccgccggcctcggcttagagtagcccctgggccgcacgctgccgcccgccggccacagagctaccgccgacgcgggcgacccccacaggcccgcagctcctccaaggtcctagagcggctccgtgcggccccgcgcttccgcttcccgtccccgcccccggtggccgcccccgggacgcctgggtccgagcccgctcccggcttggcgcggagcctgcatcccggagccgctggcggctcgggcgcctgcaccccgctgaggagctccggagggcgccggggtggcggagccggaggcggccggcaagggcggcgtgccggcgatggagcgcgcggtagagccttggggcccagatctccaccgcccggaggagagggagccacagagaggcgcccgcacaggtctagggagtgagaacgtgatttctcagccgaatgagtttgaacataccccacaggaagatgacttggggttcaaggaagaagatttggctccagatcatgaagtaggaaatgcctctctcaaacctgaaggcatccagaactgggatgacttatgggtccagagagagggtctaggaaagcctcagcctcgggacagaggcccccggctcctgggtgaaccacgctggggccaggctagtagtgatcgggccgctgtgtgtggtgagtgtggcaaaagcttcaggcagatgtcagatctggtgaaacaccagcggacccacacaggggagaaaccctacaagtgtgggg

SEQ ID NO: 202657 - DNA, 555 bp, Homo sapiens
  Payload ID: 19965
  Gene Name: zinc finger protein 48
  ENST ID: ENST00000528032
  CDS Start-End: 115-555
ctagcccgcgcgagggcggcacccgcggaggtcccggggggcgctgggcagtgtggggcgcggggattggacaagaggccgactgaaggcggagccgagggcggcgtgccggcgatggagcgcgcggtagagccttggggcccagatctccaccgcccggaggagagggagccacagagaggcgcccgcacaggtctagggagtgagaacgtgatttctcagccgaatgagtttgaacataccccacaggaagatgacttggggttcaaggaagaagatttggctccagatcatgaagtaggaaatgcctctctcaaacctgaaggcatccagaactgggatgacttatgggtccagagagagggtctaggaaagcctcagcctcgggacagaggcccccggctcctgggtgaaccacgctggggccaggctagtagtgatcgggccgctgtgtgtggtgagtgtggcaaaagcttcaggcagatgtcagatctggtgaaacaccagcggacccacacaggggagaaaccctacaagtgtggggtctgtggcaag

SEQ ID NO: 202658 - DNA, 2875 bp, Homo sapiens
  Payload ID: 19965
  Gene Name: zinc finger protein 48
  ENST ID: ENST00000622647
  CDS Start-End: 388-1875
agcccgcgcgagggcggcacccgcggaggtcccggggggcgctgggcagtgtggggcgcggggattggacaagaggccgactgaaggcggagccgaggtctagggagtgagaacgtgatttctcagccgaatgagtttgaacataccccacaggaagatgacttggggttcaaggaagaagatttggctccagatcatgaagtaggaaatgcctctctcaaacctgaaggcatccagaactgggatgacttatgggtccagagagagggtctaggaaagcctcagcctcgggacagaggcccccggctcctgggtgaaccacgctggggccaggctagtagtgatcgggccgctgtgtgtggtgagtgtggcaaaagcttcaggcagatgtcagatctggtgaaacaccagcggacccacacaggggagaaaccctacaagtgtggggtctgtggcaagggctttggggatagctctgcccggatcaaacaccagcggactcatagtggggagaagccctatagagcccggccaccagcccagggtcccccaaagattcctcggtcccggatccctgctggtgagcgccccactatctgtggtgaatgtggcaagagcttccggcagagttctgacctggtgaaacaccagcggacacacactggtgagaagccctacaagtgtggcatatgtggcaagggctttggcgacagttccgcccgcatcaagcaccagcggacacaccggggggagcagcccccccgaccagtggtgccccgacggcagccatctcgggcagccacggcagctacccagggaccgaaggcccaggacaagccatatatctgcactgattgcggcaagaggtttgtgctcagctgcagcctcctgagtcaccagcgtagtcacttggggcccaagccctttggctgtgatgtgtgtggaaaggagtttgcccggggatccgacctggtgaagcacctgcgggtgcacacgggtgagaagccctacctctgcccagagtgcggcaaaggtttcgcggacagctccgcccgagtcaaacacctccgcacccacagtggcgagaggccccatgcctgcccggaatgcgaccgtaccttcagcctcagctccacccttcttcgccaccgcctcactcacatggagccccaggacttcagcttcccaggctatcccctacccgctctgatccccagcccacccccacctcctctgggcaccagccccccgctgacacctcgaagtccctcacactcgggtgagccttttggcctgcctggcttggagccagagcctgggggcccacaggctggggagccacccccaccactggcgggcgacaagccccacaagtgccctgagtgtggcaagggcttccgccgaagctctgacctggtgaaacaccatcgtgtgcacacaggggagaaaccctacctctgtcctgaatgcggcaagggttttgctgacagctcagcccgagtcaagcacctccgcacccaccgtggtgaacgggcccggccaccaccaccatccactctgctgcggccacataacccacctggcccagtacccatggcccctcgaccccgagttcgggcccagccttctggacccagccagccccacgtgtgtggcttctgtgggaaggagttcccccggagctcagatctggtcaaacacaggcgtacacacacgggggagaagccatacaagtgtgcagagtgtggcaagggttttggtgacagttctgcccgcatcaagcaccagcgtgggcacctggtcctgacgccctttgggataggggatggtagggcaaggcccctcaagcaggaggcagcaacaggactggaatgacgcggtccagggagggcggaggcccaggagaccaaagggaggggctctgccgcttagcagagaagaaagggcctgggaggtggtgggagggagaaggaagggaagaaaggggaggaagaatagatagaaatagggattggagacagtaaccttgaagctcaggaaactgtcctggctgggctgagtcaggaccttgccaggacgggctgtacccctggcttctagaagactgcctagcacacagtaggcattcaatacttgttgaataaataaactggctttcacctaaggactcaaccctaaattcctgctgcctcatctgttaagaactgacactttccccttgctgggcaggtagtacacacctgtaatcccagcagtttgggaggctgaggtgggagaatcacttgagcccaaaagtttgaggctgcagtgagctgattgcaccactgatgcctcccaaccttgctctgggagaccaatgcctgaaccagggtttgtttaccttctgagctgcagagatggggcttctggaatttaaggtaacaggatgaggcaggggtatcttgatcatccggatggggcaaatactgctgtgtggcatggtggtacccacccctatggaggggcactcttggacagagcccagacctttgtgccctggagggagccaacccaccctgacacggagacactggcagaatagaccagagacagaaggtgctctcatggtatccagcctggatgccaagcccaagtcctggtggatagcagaggccagctgtttgggaaaagggcaggatgctctgaggcctggcagccacatttccatgtgtctttttaccaataaacggcttctcttctgaggcttggacagtgtgtgtgtacacacaggcatgaaaaaggtggagaggggtctctgcgcgcaaaactcagactgtaaattttgtgtgcttcccttgctctctgagcccattaaataaagaggttgtcttggcgt

SEQ ID NO: 202659 - DNA, 3339 bp, Homo sapiens
  Payload ID: 19965
  Gene Name: zinc finger protein 48
  Uniprot ID: Q96MX3
  ENST ID: ENST00000613509
  CDS Start-End: 483-2339
tttctttgtctctcccaggtcggagtggctggcgctgtcggccggccggggaggtcggcgcgggtggctggagacacacagccacaattacgaagagcctcgggcctcaccacccagctgcagcccaggaggcacacggttaataccaccgagttcgggccgccggcctcggcttagagtagcccctgggccgcacgctgccgcccgccggccacagagctaccgccgacgcgggcgacccccacaggcccgcagctcctccaaggtcctagagcggctccgtgcggccccgcgcttccgcttcccgtccccgcccccggtggccgcccccgggacgcctgggtccgagcccgctcccggcttggcgcggagcctgcatcccggagccgctggcggctcgggcgcctgcaccccgctgaggagctccggagggcgccggggtggcggagccggaggcggccggcaagggcggcgtgccggcgatggagcgcgcggtagagccttggggcccagatctccaccgcccggaggagagggagccacagagaggcgcccgcacaggtctagggagtgagaacgtgatttctcagccgaatgagtttgaacataccccacaggaagatgacttggggttcaaggaagaagatttggctccagatcatgaagtaggaaatgcctctctcaaacctgaaggcatccagaactgggatgacttatgggtccagagagagggtctaggaaagcctcagcctcgggacagaggcccccggctcctgggtgaaccacgctggggccaggctagtagtgatcgggccgctgtgtgtggtgagtgtggcaaaagcttcaggcagatgtcagatctggtgaaacaccagcggacccacacaggggagaaaccctacaagtgtggggtctgtggcaagggctttggggatagctctgcccggatcaaacaccagcggactcatagtggggagaagccctatagagcccggccaccagcccagggtcccccaaagattcctcggtcccggatccctgctggtgagcgccccactatctgtggtgaatgtggcaagagcttccggcagagttctgacctggtgaaacaccagcggacacacactggtgagaagccctacaagtgtggcatatgtggcaagggctttggcgacagttccgcccgcatcaagcaccagcggacacaccggggggagcagcccccccgaccagtggtgccccgacggcagccatctcgggcagccacggcagctacccagggaccgaaggcccaggacaagccatatatctgcactgattgcggcaagaggtttgtgctcagctgcagcctcctgagtcaccagcgtagtcacttggggcccaagccctttggctgtgatgtgtgtggaaaggagtttgcccggggatccgacctggtgaagcacctgcgggtgcacacgggtgagaagccctacctctgcccagagtgcggcaaaggtttcgcggacagctccgcccgagtcaaacacctccgcacccacagtggcgagaggccccatgcctgcccggaatgcgaccgtaccttcagcctcagctccacccttcttcgccaccgcctcactcacatggagccccaggacttcagcttcccaggctatcccctacccgctctgatccccagcccacccccacctcctctgggcaccagccccccgctgacacctcgaagtccctcacactcgggtgagccttttggcctgcctggcttggagccagagcctgggggcccacaggctggggagccacccccaccactggcgggcgacaagccccacaagtgccctgagtgtggcaagggcttccgccgaagctctgacctggtgaaacaccatcgtgtgcacacaggggagaaaccctacctctgtcctgaatgcggcaagggttttgctgacagctcagcccgagtcaagcacctccgcacccaccgtggtgaacgggcccggccaccaccaccatccactctgctgcggccacataacccacctggcccagtacccatggcccctcgaccccgagttcgggcccagccttctggacccagccagccccacgtgtgtggcttctgtgggaaggagttcccccggagctcagatctggtcaaacacaggcgtacacacacgggggagaagccatacaagtgtgcagagtgtggcaagggttttggtgacagttctgcccgcatcaagcaccagcgtgggcacctggtcctgacgccctttgggataggggatggtagggcaaggcccctcaagcaggaggcagcaacaggactggaatgacgcggtccagggagggcggaggcccaggagaccaaagggaggggctctgccgcttagcagagaagaaagggcctgggaggtggtgggagggagaaggaagggaagaaaggggaggaagaatagatagaaatagggattggagacagtaaccttgaagctcaggaaactgtcctggctgggctgagtcaggaccttgccaggacgggctgtacccctggcttctagaagactgcctagcacacagtaggcattcaatacttgttgaataaataaactggctttcacctaaggactcaaccctaaattcctgctgcctcatctgttaagaactgacactttccccttgctgggcaggtagtacacacctgtaatcccagcagtttgggaggctgaggtgggagaatcacttgagcccaaaagtttgaggctgcagtgagctgattgcaccactgatgcctcccaaccttgctctgggagaccaatgcctgaaccagggtttgtttaccttctgagctgcagagatggggcttctggaatttaaggtaacaggatgaggcaggggtatcttgatcatccggatggggcaaatactgctgtgtggcatggtggtacccacccctatggaggggcactcttggacagagcccagacctttgtgccctggagggagccaacccaccctgacacggagacactggcagaatagaccagagacagaaggtgctctcatggtatccagcctggatgccaagcccaagtcctggtggatagcagaggccagctgtttgggaaaagggcaggatgctctgaggcctggcagccacatttccatgtgtctttttaccaataaacggcttctcttctgaggcttggacagtgtgtgtgtacacacaggcatgaaaaaggtggagaggggtctctgcgcgcaaaactcagactgtaaattttgtgtgcttcccttgctctctgagcccattaaataaagaggttgtcttggcgt

SEQ ID NO: 202660 - DNA, 2971 bp, Homo sapiens
  Payload ID: 19965
  Gene Name: zinc finger protein 48
  Uniprot ID: Q96MX3
  ENST ID: ENST00000612608
  CDS Start-End: 115-1971
ctagcccgcgcgagggcggcacccgcggaggtcccggggggcgctgggcagtgtggggcgcggggattggacaagaggccgactgaaggcggagccgagggcggcgtgccggcgatggagcgcgcggtagagccttggggcccagatctccaccgcccggaggagagggagccacagagaggcgcccgcacaggtctagggagtgagaacgtgatttctcagccgaatgagtttgaacataccccacaggaagatgacttggggttcaaggaagaagatttggctccagatcatgaagtaggaaatgcctctctcaaacctgaaggcatccagaactgggatgacttatgggtccagagagagggtctaggaaagcctcagcctcgggacagaggcccccggctcctgggtgaaccacgctggggccaggctagtagtgatcgggccgctgtgtgtggtgagtgtggcaaaagcttcaggcagatgtcagatctggtgaaacaccagcggacccacacaggggagaaaccctacaagtgtggggtctgtggcaagggctttggggatagctctgcccggatcaaacaccagcggactcatagtggggagaagccctatagagcccggccaccagcccagggtcccccaaagattcctcggtcccggatccctgctggtgagcgccccactatctgtggtgaatgtggcaagagcttccggcagagttctgacctggtgaaacaccagcggacacacactggtgagaagccctacaagtgtggcatatgtggcaagggctttggcgacagttccgcccgcatcaagcaccagcggacacaccggggggagcagcccccccgaccagtggtgccccgacggcagccatctcgggcagccacggcagctacccagggaccgaaggcccaggacaagccatatatctgcactgattgcggcaagaggtttgtgctcagctgcagcctcctgagtcaccagcgtagtcacttggggcccaagccctttggctgtgatgtgtgtggaaaggagtttgcccggggatccgacctggtgaagcacctgcgggtgcacacgggtgagaagccctacctctgcccagagtgcggcaaaggtttcgcggacagctccgcccgagtcaaacacctccgcacccacagtggcgagaggccccatgcctgcccggaatgcgaccgtaccttcagcctcagctccacccttcttcgccaccgcctcactcacatggagccccaggacttcagcttcccaggctatcccctacccgctctgatccccagcccacccccacctcctctgggcaccagccccccgctgacacctcgaagtccctcacactcgggtgagccttttggcctgcctggcttggagccagagcctgggggcccacaggctggggagccacccccaccactggcgggcgacaagccccacaagtgccctgagtgtggcaagggcttccgccgaagctctgacctggtgaaacaccatcgtgtgcacacaggggagaaaccctacctctgtcctgaatgcggcaagggttttgctgacagctcagcccgagtcaagcacctccgcacccaccgtggtgaacgggcccggccaccaccaccatccactctgctgcggccacataacccacctggcccagtacccatggcccctcgaccccgagttcgggcccagccttctggacccagccagccccacgtgtgtggcttctgtgggaaggagttcccccggagctcagatctggtcaaacacaggcgtacacacacgggggagaagccatacaagtgtgcagagtgtggcaagggttttggtgacagttctgcccgcatcaagcaccagcgtgggcacctggtcctgacgccctttgggataggggatggtagggcaaggcccctcaagcaggaggcagcaacaggactggaatgacgcggtccagggagggcggaggcccaggagaccaaagggaggggctctgccgcttagcagagaagaaagggcctgggaggtggtgggagggagaaggaagggaagaaaggggaggaagaatagatagaaatagggattggagacagtaaccttgaagctcaggaaactgtcctggctgggctgagtcaggaccttgccaggacgggctgtacccctggcttctagaagactgcctagcacacagtaggcattcaatacttgttgaataaataaactggctttcacctaaggactcaaccctaaattcctgctgcctcatctgttaagaactgacactttccccttgctgggcaggtagtacacacctgtaatcccagcagtttgggaggctgaggtgggagaatcacttgagcccaaaagtttgaggctgcagtgagctgattgcaccactgatgcctcccaaccttgctctgggagaccaatgcctgaaccagggtttgtttaccttctgagctgcagagatggggcttctggaatttaaggtaacaggatgaggcaggggtatcttgatcatccggatggggcaaatactgctgtgtggcatggtggtacccacccctatggaggggcactcttggacagagcccagacctttgtgccctggagggagccaacccaccctgacacggagacactggcagaatagaccagagacagaaggtgctctcatggtatccagcctggatgccaagcccaagtcctggtggatagcagaggccagctgtttgggaaaagggcaggatgctctgaggcctggcagccacatttccatgtgtctttttaccaataaacggcttctcttctgaggcttggacagtgtgtgtgtacacacaggcatgaaaaaggtggagaggggtctctgcgcgcaaaactcagactgtaaattttgtgtgcttcccttgctctctgagcccattaaataaagaggttgtcttggcgt

SEQ ID NO: 202661 - DNA, 1843 bp, Homo sapiens
  Payload ID: 19966
  Gene Name: zinc finger protein 480
  ENST ID: ENST00000334564
  CDS Start-End: 65-1543
aaacccggaagcggatcgcgtggagtgaaggtcacgccgcggcgcgattgacttctaaagagtcatgctgtgtgatgaaaaagcccagaagagaaggaagaggaaagcaaaggagtcagggatggctcttcctcagggacacttaacattcagggacgtggccatagaattctctcaggcggagtggaaatgcctggaccctgcacagagggctttatacaaggatgtgatgttggagaactacaggaacctggtctccctggggagcagctatgcattgggaagcaatgcagaagacaaaccaattaaaaaacaacttggagtatcctttcacttacatctgtctgaactggagctatttccagatgaaagggtaataaatggatgtaatcaagttgaaaactttatcaaccacagttcctctgtttcctgtcttcaagaaatgtcttccagtgtcaaaacccccatttttaataggaatgattttgatgattcttcatttctcccacaagaacagaaagtacaccttagagaaaaaccttatgaatgtaatgagcatagcaaagtctttagagtatcttccagccttactaaacatcaagtaatccatactgtagagaaaccttacaaatgtaattcatgcggcaaggtctttagtcgcaattcacaccttgcagaacattgtagaattcatactggagagaaaccttacaaatgtaatgtctgtggcaaggtttttagttacaattcaaactttgcacgacatcaaagaattcataccagagagaagccgtatgaatgtaatgaatgtggtaaagtcttcagtaataattcttaccttgcacgacatcaaagaattcatgctgaagagaaaccttacaaatgtaatgaatgtggtaaaggcttcagtcataagtcatctctagcaaatcattggagaatttatactggagagaagccttacaaatgtgatgaatgtggcaaggccttctataggattgcgctccttgtacgacatcagaaaattcatactggagagaaaccttacaaatgtaatgaatgtggaaaggtctttattcaaaattcgcacctagcacaacattggagaattcatacaggagagaaaccttacaaatgtaatgaatgtggaaaagtatttaatcaactttcaaatcttgcacgacatcgaagaattcatactggagagaagccttacaaatgtaatgaatgtggtaaagcatttagtgagtattcaggcctttcagcccatcttgtaatccacactggagagaagccttacaaatgtagtgaatgtggcaaggcattcagacacaagttatcactaaccaatcatcagagaatccatactggagaaagaccttacaaatgtaatgaatgtggcaaggtcttcaatcgaattgcacaccttgcacgacatcggaaaattcatactggagagaaaccttacaaatgtaatgagtgtggcaaggcctttagtcgcatttcatacctagcacaacattggacaattcatatgggatagaaactacaaatgcaacaaatgcgtcaaagaatttagtgtgcactcaagccttactacccatcttttattccatactgcaaagaaattttgcaaatgtaaagaatatgacaaggtcttcaaacacaagtttttctaataactcattagagaatttatactggagagacttcacaattataataaatgtgtggaaaagtcttcaaaaaaatttcacaccttgcaaaaggagatctaaaaaacacaatcagaaatgacaaaggggacattaccaccaaccccacagaaatacgaaaaaccctc

SEQ ID NO: 202662 - DNA, 2722 bp, Homo sapiens
  Payload ID: 19966
  Gene Name: zinc finger protein 480
  Uniprot ID: Q8WV37
  ENST ID: ENST00000335090
  CDS Start-End: 124-1500
gattgacttctaaagagtcatgctgtgtgatgaaaaagcccagaagagaaggaagaggaaagcaaaggagtcagggatggctcttcctcaggaatctctcttcctgacctgaatattaactccatgttggagcaaaggagggagccctggtctggtgagagtgaagtgaaaatagcaaaaaattcagatgggagggagtgcatcaaaggtgtgaacacagggagcagctatgcattgggaagcaatgcagaagacaaaccaattaaaaaacaacttggagtatcctttcacttacatctgtctgaactggagctatttccagatgaaagggtaataaatggatgtaatcaagttgaaaactttatcaaccacagttcctctgtttcctgtcttcaagaaatgtcttccagtgtcaaaacccccatttttaataggaatgattttgatgattcttcatttctcccacaagaacagaaagtacaccttagagaaaaaccttatgaatgtaatgagcatagcaaagtctttagagtatcttccagccttactaaacatcaagtaatccatactgtagagaaaccttacaaatgtaattcatgcggcaaggtctttagtcgcaattcacaccttgcagaacattgtagaattcatactggagagaaaccttacaaatgtaatgtctgtggcaaggtttttagttacaattcaaactttgcacgacatcaaagaattcataccagagagaagccgtatgaatgtaatgaatgtggtaaagtcttcagtaataattcttaccttgcacgacatcaaagaattcatgctgaagagaaaccttacaaatgtaatgaatgtggtaaaggcttcagtcataagtcatctctagcaaatcattggagaatttatactggagagaagccttacaaatgtgatgaatgtggcaaggccttctataggattgcgctccttgtacgacatcagaaaattcatactggagagaaaccttacaaatgtaatgaatgtggaaaggtctttattcaaaattcgcacctagcacaacattggagaattcatacaggagagaaaccttacaaatgtaatgaatgtggaaaagtatttaatcaactttcaaatcttgcacgacatcgaagaattcatactggagagaagccttacaaatgtaatgaatgtggtaaagcatttagtgagtattcaggcctttcagcccatcttgtaatccacactggagagaagccttacaaatgtagtgaatgtggcaaggcattcagacacaagttatcactaaccaatcatcagagaatccatactggagaaagaccttacaaatgtaatgaatgtggcaaggtcttcaatcgaattgcacaccttgcacgacatcggaaaattcatactggagagaaaccttacaaatgtaatgagtgtggcaaggcctttagtcgcatttcatacctagcacaacattggacaattcatatgggatagaaactacaaatgcaacaaatgcgtcaaagaatttagtgtgcactcaagccttactacccatcttttattccatactgcaaagaaattttgcaaatgtaaagaatatgacaaggtcttcaaacacaagtttttctaataactcattagagaatttatactggagagacttcacaattataataaatgtgtggaaaagtcttcaaaaaaatttcacaccttgcaaaaggagatctaaaaaacacaatcagaaatgacaaaggggacattaccaccaaccccacagaaatacgaaaaaccctcaaagattactataaacacctgtatgcacacaaactagaaaacctagaaaaaattaataaattccttgaaagatataaccccccaagattgaaccaagaagaaattgcatccctgaacagaccaataatgagttccaaaatttaatcactaattaaaaatctatcaaacaaaactctggaccagacagatttatagttgaagcctacgagatgtataaagaaaagctgttaccaatcttactgaaactgttcaaaaacatggatgcagagggactcctccctatctgattctatgaggccagcatcattctaataccaaaacctgacaggcacaatgaaaaaagaaaacttcaggctggtactcctgacgaatataggtgccaaaatcctcagcaaaatactagtaaaccaaatccatctgcacatcaaaaagctaatccaacattatcaagcaggctttagtgttgggctgcaaggttggttcagtatacacaaatcaataaatgtgatttatcacatacacagaactaaaaacaaaaaccacatgaccatgatcatctctttagatgcagaaaggtttttaataaaattcaacatcccttcattttaaaaaccctcaacaaattacacattgagggaacatacttcaataagaaccatctatgctggactcacagccaaattaatactgaacaagcaaaagctggaagcattccccttgagaactggaaaatgacagggatgaccactctcaccactccgattcaacatagtactggaagtcctaagcttagtgatcaggcaagataaagatatgaaaggcatatataaataggaagaggggaagtcagtttctcttgcagaagatataattctgtatttagaaaacctgttgtctctgcccaaaggctcctagatctgat

SEQ ID NO: 202663 - DNA, 2527 bp, Homo sapiens
  Payload ID: 19966
  Gene Name: zinc finger protein 480
  Uniprot ID: Q8WV37
  ENST ID: ENST00000468240
  CDS Start-End: 67-1674
acaaacccggaagcggatcgcgtggagtgaaggtcacgccgcggcgcgattgacttctaaagagtcatgctgtgtgatgaaaaagcccagaagagaaggaagaggaaagcaaaggagtcagggatggctcttcctcagggacacttaacattcagggacgtggccatagaattctctcaggcggagtggaaatgcctggaccctgcacagagggctttatacaaggatgtgatgttggagaactacaggaacctggtctccctgggaatctctcttcctgacctgaatattaactccatgttggagcaaaggagggagccctggtctggtgagagtgaagtgaaaatagcaaaaaattcagatgggagggagtgcatcaaaggtgtgaacacagggagcagctatgcattgggaagcaatgcagaagacaaaccaattaaaaaacaacttggagtatcctttcacttacatctgtctgaactggagctatttccagatgaaagggtaataaatggatgtaatcaagttgaaaactttatcaaccacagttcctctgtttcctgtcttcaagaaatgtcttccagtgtcaaaacccccatttttaataggaatgattttgatgattcttcatttctcccacaagaacagaaagtacaccttagagaaaaaccttatgaatgtaatgagcatagcaaagtctttagagtatcttccagccttactaaacatcaagtaatccatactgtagagaaaccttacaaatgtaattcatgcggcaaggtctttagtcgcaattcacaccttgcagaacattgtagaattcatactggagagaaaccttacaaatgtaatgtctgtggcaaggtttttagttacaattcaaactttgcacgacatcaaagaattcataccagagagaagccgtatgaatgtaatgaatgtggtaaagtcttcagtaataattcttaccttgcacgacatcaaagaattcatgctgaagagaaaccttacaaatgtaatgaatgtggtaaaggcttcagtcataagtcatctctagcaaatcattggagaatttatactggagagaagccttacaaatgtgatgaatgtggcaaggccttctataggattgcgctccttgtacgacatcagaaaattcatactggagagaaaccttacaaatgtaatgaatgtggaaaggtctttattcaaaattcgcacctagcacaacattggagaattcatacaggagagaaaccttacaaatgtaatgaatgtggaaaagtatttaatcaactttcaaatcttgcacgacatcgaagaattcatactggagagaagccttacaaatgtaatgaatgtggtaaagcatttagtgagtattcaggcctttcagcccatcttgtaatccacactggagagaagccttacaaatgtagtgaatgtggcaaggcattcagacacaagttatcactaaccaatcatcagagaatccatactggagaaagaccttacaaatgtaatgaatgtggcaaggtcttcaatcgaattgcacaccttgcacgacatcggaaaattcatactggagagaaaccttacaaatgtaatgagtgtggcaaggcctttagtcgcatttcatacctagcacaacattggacaattcatatgggatagaaactacaaatgcaacaaatgcgtcaaagaatttagtgtgcactcaagccttactacccatcttttattccatactgcaaagaaattttgcaaatgtaaagaatatgacaaggtcttcaaacacaagtttttctaataactcattagagaatttatactggagagacttcacaattataataaatgtgtggaaaagtcttcaaaaaaatttcacaccttgcaaaaggagatctaaaaaacacaatcagaaatgacaaaggggacattaccaccaaccccacagaaatacgaaaaaccctcaaagattactataaacacctgtatgcacacaaactagaaaacctagaaaaaattaataaattccttgaaagatataaccccccaagattgaaccaagaagaaattgcatccctgaacagaccaataatgagttccaaaatttaatcactaattaaaaatctatcaaacaaaactctggaccagacagatttatagttgaagcctacgagatgtataaagaaaagctgttaccaatcttactgaaactgttcaaaaacatggatgcagagggactcctccctatctgattctatgaggccagcatcattctaataccaaaacctgacaggcacaatgaaaaaagaaaacttcaggctggtactcctgacgaatataggtgccaaaatcctcagcaaaatactagtaaaccaaatccatctgcacatcaaaaagctaatccaacattatcaagcaggctttagtgttgggctgcaaggttggttcagtatacacaaatcaataaatgtgatttatcacatactccttgaacctaaaataaaacatgaaaaaaagc

SEQ ID NO: 202664 - DNA, 2238 bp, Homo sapiens
  Payload ID: 19966
  Gene Name: zinc finger protein 480
  ENST ID: ENST00000490272
  CDS Start-End: 65-250
aaacccggaagcggatcgcgtggagtgaaggtcacgccgcggcgcgattgacttctaaagagtcatgctgtgtgatgaaaaagcccagaagagaaggaagaggaaagcaaaggagtcagggatggctcttcctcagggagcagctatgcattgggaagcaatgcagaagacaaaccaattaaaaaacaacttggagtatcctttcacttacatctgtctgaactggagctatttccagatgaaagggtaataaatggatgtaatcaagttgaaaactttatcaaccacagttcctctgtttcctgtcttcaagaaatgtcttccagtgtcaaaacccccatttttaataggaatgattttgatgattcttcatttctcccacaagaacagaaagtacaccttagagaaaaaccttatgaatgtaatgagcatagcaaagtctttagagtatcttccagccttactaaacatcaagtaatccatactgtagagaaaccttacaaatgtaattcatgcggcaaggtctttagtcgcaattcacaccttgcagaacattgtagaattcatactggagagaaaccttacaaatgtaatgtctgtggcaaggtttttagttacaattcaaactttgcacgacatcaaagaattcataccagagagaagccgtatgaatgtaatgaatgtggtaaagtcttcagtaataattcttaccttgcacgacatcaaagaattcatgctgaagagaaaccttacaaatgtaatgaatgtggtaaaggcttcagtcataagtcatctctagcaaatcattggagaatttatactggagagaagccttacaaatgtgatgaatgtggcaaggccttctataggattgcgctccttgtacgacatcagaaaattcatactggagagaaaccttacaaatgtaatgaatgtggaaaggtctttattcaaaattcgcacctagcacaacattggagaattcatacaggagagaaaccttacaaatgtaatgaatgtggaaaagtatttaatcaactttcaaatcttgcacgacatcgaagaattcatactggagagaagccttacaaatgtaatgaatgtggtaaagcatttagtgagtattcaggcctttcagcccatcttgtaatccacactggagagaagccttacaaatgtagtgaatgtggcaaggcattcagacacaagttatcactaaccaatcatcagagaatccatactggagaaagaccttacaaatgtaatgaatgtggcaaggtcttcaatcgaattgcacaccttgcacgacatcggaaaattcatactggagagaaaccttacaaatgtaatgagtgtggcaaggcctttagtcgcatttcatacctagcacaacattggacaattcatatgggatagaaactacaaatgcaacaaatgcgtcaaagaatttagtgtgcactcaagccttactacccatcttttattccatactgcaaagaaattttgcaaatgtaaagaatatgacaaggtcttcaaacacaagtttttctaataactcattagagaatttatactggagagacttcacaattataataaatgtgtggaaaagtcttcaaaaaaatttcacaccttgcaaaaggagatctaaaaaacacaatcagaaatgacaaaggggacattaccaccaaccccacagaaatacgaaaaaccctcaaagattactataaacacctgtatgcacacaaactagaaaacctagaaaaaattaataaattccttgaaagatataaccccccaagattgaaccaagaagaaattgcatccctgaacagaccaataatgagttccaaaatttaatcactaattaaaaatctatcaaacaaaactctggaccagacagatttatagttgaagcctacgagatgtataaagaaaagctgttaccaatcttactgaaactgttcaaaaacatggatgcagagggactcctccctatctgattctatgaggccagcatcattctaataccaaaacctgacaggcacaatgaaaaaagaaaacttcaggctggtactcctgacgaatataggtgccaaaatcctcagcaaaatactagtaaaccaaatccatctgcacatcaaaaagctaatccaacattatcaagcaggctttagtgttgggctgcaaggttggttcagtatacacaaatcaataaatgtgatttatcacatacac

SEQ ID NO: 202665 - DNA, 4738 bp, Homo sapiens
  Payload ID: 19966
  Gene Name: zinc finger protein 480
  Uniprot ID: Q8WV37
  ENST ID: ENST00000595962
  CDS Start-End: 67-1674
acaaacccggaagcggatcgcgtggagtgaaggtcacgccgcggcgcgattgacttctaaagagtcatgctgtgtgatgaaaaagcccagaagagaaggaagaggaaagcaaaggagtcagggatggctcttcctcagggacacttaacattcagggacgtggccatagaattctctcaggcggagtggaaatgcctggaccctgcacagagggctttatacaaggatgtgatgttggagaactacaggaacctggtctccctgggaatctctcttcctgacctgaatattaactccatgttggagcaaaggagggagccctggtctggtgagagtgaagtgaaaatagcaaaaaattcagatgggagggagtgcatcaaaggtgtgaacacagggagcagctatgcattgggaagcaatgcagaagacaaaccaattaaaaaacaacttggagtatcctttcacttacatctgtctgaactggagctatttccagatgaaagggtaataaatggatgtaatcaagttgaaaactttatcaaccacagttcctctgtttcctgtcttcaagaaatgtcttccagtgtcaaaacccccatttttaataggaatgattttgatgattcttcatttctcccacaagaacagaaagtacaccttagagaaaaaccttatgaatgtaatgagcatagcaaagtctttagagtatcttccagccttactaaacatcaagtaatccatactgtagagaaaccttacaaatgtaattcatgcggcaaggtctttagtcgcaattcacaccttgcagaacattgtagaattcatactggagagaaaccttacaaatgtaatgtctgtggcaaggtttttagttacaattcaaactttgcacgacatcaaagaattcataccagagagaagccgtatgaatgtaatgaatgtggtaaagtcttcagtaataattcttaccttgcacgacatcaaagaattcatgctgaagagaaaccttacaaatgtaatgaatgtggtaaaggcttcagtcataagtcatctctagcaaatcattggagaatttatactggagagaagccttacaaatgtgatgaatgtggcaaggccttctataggattgcgctccttgtacgacatcagaaaattcatactggagagaaaccttacaaatgtaatgaatgtggaaaggtctttattcaaaattcgcacctagcacaacattggagaattcatacaggagagaaaccttacaaatgtaatgaatgtggaaaagtatttaatcaactttcaaatcttgcacgacatcgaagaattcatactggagagaagccttacaaatgtaatgaatgtggtaaagcatttagtgagtattcaggcctttcagcccatcttgtaatccacactggagagaagccttacaaatgtagtgaatgtggcaaggcattcagacacaagttatcactaaccaatcatcagagaatccatactggagaaagaccttacaaatgtaatgaatgtggcaaggtcttcaatcgaattgcacaccttgcacgacatcggaaaattcatactggagagaaaccttacaaatgtaatgagtgtggcaaggcctttagtcgcatttcatacctagcacaacattggacaattcatatgggatagaaactacaaatgcaacaaatgcgtcaaagaatttagtgtgcactcaagccttactacccatcttttattccatactgcaaagaaattttgcaaatgtaaagaatatgacaaggtcttcaaacacaagtttttctaataactcattagagaatttatactggagagacttcacaattataataaatgtgtggaaaagtcttcaaaaaaatttcacaccttgcaaaaggagatctaaaaaacacaatcagaaatgacaaaggggacattaccaccaaccccacagaaatacgaaaaaccctcaaagattactataaacacctgtatgcacacaaactagaaaacctagaaaaaattaataaattccttgaaagatataaccccccaagattgaaccaagaagaaattgcatccctgaacagaccaataatgagttccaaaatttaatcactaattaaaaatctatcaaacaaaactctggaccagacagatttatagttgaagcctacgagatgtataaagaaaagctgttaccaatcttactgaaactgttcaaaaacatggatgcagagggactcctccctatctgattctatgaggccagcatcattctaataccaaaacctgacaggcacaatgaaaaaagaaaacttcaggctggtactcctgacgaatataggtgccaaaatcctcagcaaaatactagtaaaccaaatccatctgcacatcaaaaagctaatccaacattatcaagcaggctttagtgttgggctgcaaggttggttcagtatacacaaatcaataaatgtgatttatcacatacacagaactaaaaacaaaaaccacatgaccatgatcatctctttagatgcagaaaggtttttaataaaattcaacatcccttcattttaaaaaccctcaacaaattacacattgagggaacatacttcaataagaaccatctatgctggactcacagccaaattaatactgaacaagcaaaagctggaagcattccccttgagaactggaaaatgacagggatgaccactctcaccactccgattcaacatagtactggaagtcctaagcttagtgatcaggcaagataaagatatgaaaggcatatataaataggaagaggggaagtcagtttctcttgcagaagatataattctgtatttagaaaacctgttgtctctgcccaaaggctcctagatctgataaacaacttcaaaaaagtttcaggatacaaaatctgtgtacaaaaattagttgcatttctatacaccagtaatgtccaagctatgaaccaaatcaagaatggaatcccattcacagtagccacaaaaagtataaaatacctaggaatacagccaaccaggtaagtgaaagatttctacaatgagaattacaaagcagtgcacaaagaaatcagaaacaataaaaattgaaaaatatctcatgctcatggataggaagaatcagtattgttaaaatactgcccaaagcaatttacagagccaatgctatttctatcaaactaccaatggcatttttcacagaatcagaagaaaacattctgaaatttatttggaaccagaaaagcccaacctaaatagcaaaagcaatcctaagcaaaaagagcaatgtttgaggtatcacactacccaactttaaaccatactacaaggctacagcaactaaaacagcatggtactggtataaaaaaagacacatagatcaatggaataggtaagagaacccagaaataaaggcatatacctacaaccatgtgatcctcaacaaaactgacaagcaatgaagtaagaacttcattcaataagtggtgctggcataactggctagccatatgcaggatattgaaactggacccctatccttcacgatatacaaaaatcaactcaagatggattaaagacttaaatataaaacctaaaagtattaaattcctagaagaaaacccaggaaatgccattctggacataagtgctggaaaagacttaatgatgaacaccccaaagcaattgcaacaaaaacaaaaattgacaagtgggacctaattaaactaaataacttctgcacagcaaaagaagctatttgcagactacagaatgggagaaaatgtttacaaactgcatctgacaaagatctaatccagaatctataaagaactcaaacaaatcaacaatgagaaaaacaaccccattaaaaactgggcaaaggccatgaatagacctttctcaaaagaatacatacatgtggcaataagcatatgaaaaaaatggttaatatcgctaatcattaaggaaatgcaatcaaagccacaatgagataccatctcagacctgtctgaatgggtattatcagaatgggtattattaaaaaatcaaaacatagatgctagtgaggctgcagagaaaagcaaatacttatacactgctggtgggaatgtaaattaattcagccattgtggaaagcactgcagcgatttctcaaagacataaaagaacatagcattcaacccagcatcccattactgggtgtatacctaaaggaatataatcattccaccataaagacaaacacttgtatgttcattgcagcactattctcaatagcaaagatgtggaatcaacgtaaatgcccatcagcagtagaccagataaagaaaatttggtacatatacaccatggaatactatgcagccataaaaaagaacaagactgtgtcctttacagcaacatagatggagctgaggctcttatcctaagtgaattaatgcaggaacagaaaatgaaatatcccatgttctcacttataagtgggagctaaacattgattacacatggactcaaagaagggaacagtagacacgggcttatgggtggaggttgggaagaggatgaagattgaataactgcctgttgggtactatgctgattacctggggacaaaattaactgtacaccaaactcctgcaacatgcagttgacccatgtacacatactccttgaacctaaaataaaacatgaaaaaaagcaaa

SEQ ID NO: 202666 - DNA, 559 bp, Homo sapiens
  Payload ID: 19966
  Gene Name: zinc finger protein 480
  ENST ID: ENST00000598016
  CDS Start-End: 65-559
aaacccggaagcggatcgcgtggagtgaaggtcacgccgcggcgcgattgacttctaaagagtcatgctgtgtgatgaaaaagcccagaagagaaggaagaggaaagcaaaggagtcagggatggctcttcctcagggacacttaacattcagggacgtggccatagaattctctcaggcggagtggaaatgcctggaccctgcacagagggctttatacaaggatgtgatgttggagaactacaggaacctggtctccctgggaatctctcttcctgacctgaatattaactccatgttggagcaaaggagggagccctggtctggtgagagtgaagtgaaaatagcaaaaaattcagatgggagggagtgcatcaaaggtgtgaacacaggctggagtgcaatggtgcaatctcggctaactgcaacctccacctcctgggttcaagcagttctcctgcctcagcctcctgagcagctgggattacagggagcagctatgcattgggaagcaatgcagaagacaaaccaattaaaaaacaacttggagtatcctttc

SEQ ID NO: 202667 - DNA, 3655 bp, Homo sapiens
  Payload ID: 19967
  Gene Name: zinc finger protein 483
  Uniprot ID: Q8TF39
  ENST ID: ENST00000309235
  CDS Start-End: 159-2393
cgttggtgctgtttgcggatgctgatgcagtttctgcaggactgtaaactggattcctggaacctttgatattcctggctgtgtatagtgcctgttggtggactgtactgatactcaactagagtgtgaagggactggattcctgcccctgagacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcacaacatcctgagagtagtgaggaagtggtgaccctaatagaagatttgacccagatgcttgaagaaaaagatccagtctctcaagattctactgtttcccaagaggagaactcaaaagaggataaaatggtcactgtttgtcccaatactgagtcctgtgaatctataacattgaaggatgtagctgtgaacttttcaagaggagagtggaagaagctggagccttttcaaaaggagctatataaggaagtgctactggaaaacctcaggaacctagaatttctggactttccagtttcaaaattagagttgatttcccagctaaagtgggttgaattgccatggctgctggaagaagtctcaaaaagctcccgactagatgaatcagctttagataaaataatagaaaggtgcctcagggatgatgatcatggcttgatggaagaatcccagcaatattgtggcagctcagaggaggatcacggtaatcagggaaattcaaaaggaagagtcgcacaaaacaaaactcttgggagtggcagtaggggtaagaaatttgacccagataaaagcccctttggacataatttcaaagaaacttcagacttaattaaacatctgagagtctacttgaggaagaaatctcggaggtataatgaaagcaagaaacccttcagttttcattcagaccttgttctgaaccgcaaggagaaaaccgccggagaaaagtcacggaaatctaatgatggtgggaaagtcctgagtcactcttcagctcttactgaacatcagaaacgtcagaagattcatttgggggataggtcccaaaaatgcagtaagtgtgggataatctttattagaagatcaactctttctaggagaaaaacccctatgtgtgagaaatgtcggaaagattcatgtcaagaagcagccttaaataaagatgagggaaatgagagtggagaaaaaactcataaatgtagtaagtgtggaaaagcctttggctatagcgcctcactcaccaaacatcggagaattcacactggagaaaaaccctatatgtgtaatgaatgtggaaaagcttttagtgatagttcatcgctcacaccacatcatagaactcatagtggagagaaacccttcaaatgtgatgactgtgggaaaggtttcaccctaagtgctcacctcattaaacatcagagaattcatactggagaaaaaccttataaatgtaaagactgtgggagaccctttagtgacagttcatctcttattcaacatcagcgaattcatactggagaaaaaccctatacatgtagcaattgtggaaaatccttcagtcatagctcatccctttccaaacatcagagaattcatactggagagaaaccctataaatgtggcgaatgtggaaaagcctttaggcagaattcatgccttacccggcatcagagaattcacactggagaaaaaccatatttgtgtaatgattgcggaatgacttttagccattttacgtctgtgatttatcatcaaagacttcattcaggagaaaaaccctacaaatgtaaccagtgtgagaaagccttcccaacccattcactgctaagtcgtcatcagagaattcatactggtgtaaaaccttataaatgtaaagaatgtgggaagtccttcagtcagagttcatctcttaatgagcaccaccgaattcatacaggagagaaaccctatgagtgtaactattgtggtgcaacctttagtcgaagctcaatccttgtagaacacctaaaaattcataccggaaggagagaatatgaatgtaacgaatgtgagaagacatttaaaagtaattcaggcctcattagacatcggggatttcactctgcagagtaatcctggaactacattaaagtggggggaatttaattcaaattgtcagttactgaaaccctgggatgtaaacttacagtattgatcagtagctgcagctttcgtaaattggcagttaggaaaaatatccttttgcccattcatccctcttcttttcaaggatggcaacgactggtaaacagtaattagttggtaaagtcactggaaagggaagaatgcaaaatgattctgaggccagacgaattggaaaagctcttttcttcaggggatttctctctgatttcttctactaccatgtagtgtgatggagagaacttgactgcagtcacataacttggattctgtcccagtttgccaaccaacttgctgtatacaccttggacaagtcatttgacctttcagaattttattttcgtcaccagcagaatgaagggatgggattaatgatttttgccttttttggttttttagttttttattggtatcctgataatctctgaagctgtggacataagttatttttttttatttgtcattactttcaagtttctctagtaaaaaatacaataccactattcaggatgctggacttcttttcttttttttttcttttttttttttcaatttttcttttttgggatggagtctcactatgttgcccagactggtcttgaactcctgggctcaagtgatccttccatctcactttcctgagtagctgacattacgggtacactccatcaagcctggttcctaggatgctggacttctagcttagtgagaatgcagtatactttttgaaaacttcgtgcaggaatccctcaaatgctgtaactaggaatgggtcagtgaagttcaaacgacttttccttgagggagtattttaatcggacaagggaactctttttcttttgggcattggccaacaggactgagaagccagagagcttgcacctgagccatctcagccgtgagagtaacagtcctaggaaaatagatgggggctgggggtaaggaaatgtgctgaagacagagctattctggatggattttggtttgcaaaaattctactttaaaacaattttgcctgtagcaagtacatttttttgcaattggagtgtaaacattctgtgtggcaacagttaaaagctgttataacaatttgcttgggtgtgtgtgcatgtgtgtgtgtgtgtgtgtgtgtgtatacattgttgccactatctaaaattagggcatttcatactaaaaacaaagcttgtctt

SEQ ID NO: 202668 - DNA, 2433 bp, Homo sapiens
  Payload ID: 19967
  Gene Name: zinc finger protein 483
  Uniprot ID: Q8TF39
  ENST ID: ENST00000358151
  CDS Start-End: 233-1003
gcaggcgcagtggttcccgcaggcttgcgcgcgcactcgctgcgggacaagcttctggaagctctttgcggtggcgttggtgctgtttgcggatgctgatgcagtttctgcaggactgtaaactggattcctggaacctttgatattcctggctgtgtatagtgcctgttggtggactgtactgatactcaactagagtgtgaagggactggattcctgcccctgagacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcacaacatcctgagagtagtgaggaagtggtgaccctaatagaagatttgacccagatgcttgaagaaaaagatccagtctctcaagattctactgtttcccaagaggagaactcaaaagaggataaaatggtcactgtttgtcccaatactgagtcctgtgaatctataacattgaaggatgtagctgtgaacttttcaagaggagagtggaagaagctggagccttttcaaaaggagctatataaggaagtgctactggaaaacctcaggaacctagaatttctggactttccagtttcaaaattagagttgatttcccagctaaagtgggttgaattgccatggctgctggaagaagtctcaaaaagctcccgactagacatacatggagcagtaaaaaagatgcagatgttctctgaggctgaataagaccatgctctgccttcttgtttcaactgttacacagagatgaccagaggatggggccactgcagtgcagttcaagaggctctggttcggggaagagctggatggagtatgaatcccaactctgggggtattagctagtggagtggccataggcaagttacttaacacttctgaacctccttttgtctttcataaaataaaagctactaggatgagttgttttaaggatttcagattatagtctatgtgagatatgtgcaaacatgtacatatttcccctagaagcaatggttttcagccttggtggtgaccttatagaacataaatattgtgaataatgaaaatccactgaatctaataagggacttgtatcggtaagatgtaaagaactcttggccaggtgtggtggctcatgcctataatcccagcactttgggaggccaaggcaggtggatcacctgaggtcaggagttcgagaccaacctggccaacatgacgaaactccgtctctatttaaaatacaaaaattagctgggcatggtggtgcatgcctgtaatcccagctactcgggaggctgaggcaggagaatcacttgaactcgggaggtggaggttgcagtgagccaagatcgcgccactgcactccagcctggatgacagagcaaaaaactgtctcaaaaaaaaaaaaatcttacaacctcacaaataacctagttcaaaaatgggcaaagattttgaacagatatttctccaaagaagatatacaaatggcaaatacatacgttgaaagatccttaatattgttagccatagggaaatgcaagtcaaactcaaatcagaatgaaatatcacttcaaacctactaggatggttataataaaaaagacagacaatagcacgtgttggtgagtatgtagagaagttggaaccctcatacactgcttgtgggaatgtaaagtactgtagccactttgcaaaacagtttgacagctcctcaaaatgttaaacatgaaattatcatatgacccagcaattctactcataggtatatacttaaaagaaatgaaaaatccacacaaaaacctctgcatgaatgttcatagtaacattatacttcatagccagaaagtataagctaatacccatcaggctgggtgtggtggctcacgcctgtaatcctagcactttgggaggccgagttgggaggtttgcttgagcccaggagttccagaccagcctgggcaacatggcgaaaccccatctctactaaaaatataaaaattagttgcgtgtggtggcacatccctatagtcccagctacttgggaggctgaggtggaaggattgcttgagcgagggaggtcgaggctgcagtgagccacgatcacaccactgcactccagcctaggtgacagagtgagatcctgtctc

SEQ ID NO: 202669 - DNA, 800 bp, Homo sapiens
  Payload ID: 19967
  Gene Name: zinc finger protein 483
  ENST ID: ENST00000374374
  CDS Start-End: 176-712
gaagctctttgcggtggcgttggtgctgtttgcggatgctgatgcagtttctgcaggactgtaaactggattcctggaacctttgatattcctggctgtgtatagtgcctgttggtggactgtactgatactcaactagagtgtgaagggactggattcctgcccctgagacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcacaacatcctgagagtagtgaggaagtggtgaccctaatagaagatttgacccagatgcttgaagaaaaaggtgagatttatagatggagggaggaagcgggagacattgcctcaaagtccgaaagtaaattcctcaaaagaaggcaatttactgctaaagaggagtctgaggttagaagttgggactgggtttgaatcagccctgccatttactgtgtgattttgggcaagctgtgtaaactctcagaatgtaaatatttttatctgttaaaaagggatttta

SEQ ID NO: 202670 - DNA, 1239 bp, Homo sapiens
  Payload ID: 19967
  Gene Name: zinc finger protein 483
  ENST ID: ENST00000355824
  CDS Start-End: 203-937
gcgcactcgctgcgggacaagcttctggaagctctttgcggtggcgttggtgctgtttgcggatgctgatgcagtttctgcaggactgtaaactggattcctggaacctttgatattcctggctgtgtatagtgcctgttggtggactgtactgatactcaactagagtgtgaagggactggattcctgcccctgagacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcacaacatcctgagagtagtgaggaagtggtgaccctaatagaagatttgacccagatgcttgaagaaaaagatccagtctctcaagattctactgtttcccaagaggagaactcaaaagaggataaaatggtcactgtttgtcccaatactgagtcctgtgaatctataacattgaaggatgtagctgtgaacttttcaagaggagagtggaagaagctggagccttttcaaaaggagctatataaggaagtgctactggaaaacctcaggaacctagaatttctggactttccagtttcaaaattagagttgatttcccagctaaagtgggttgaattgccatggctgctggaagaagtctcaaaaagctcccgactaggaagtgtgatttgataaaggttcaataagagaatgaggctgggtgtggtggctcatgcctgtaatcccagcactttgggaggccaaggcaggtggatcacctgaggtcaggaattgaagaccagcctgaccaacatggagaagccccatctctactaaaaatacaaaattagctgggcgtggtggtacatgcctgtaatccaggctacttgggaggctgaggcaggagaatcgcttgaacctgggaggcagagattgcggtgagccaagatcgcacattgcatccagcctgggcaacaagagcaaaactccgtctc

SEQ ID NO: 202671 - DNA, 2867 bp, Homo sapiens
  Payload ID: 19968
  Gene Name: zinc finger protein 484
  Uniprot ID: Q5JVG2
  ENST ID: ENST00000375495
  CDS Start-End: 150-2708
tacctctaggcctgggaggcattgagaaaaaggaagtgggtcctgttctggttcttgcgactatagtcacctcccgaggcaaatgaccactgtcctgagaggacgtgggtgaggggcagatttctgcccctttgtccgaagagccaaaaatgaccaagtccctggaatcagtgtcattcaaggacgtaactgtagacttcagtagggatgagtggcaacaattagaccttgctcagaaaagcctgtacagagaagtgatgctggaaaactatttcaacttgatctcagtgggatgtcaagttcccaaaccagaagtcatcttcagcttggaacaagaagagccatgtatgttggatggtgagatccccagtcagagccgtccagatggggacattggttttggacctttacaacagaggatgtctgaagaagtttctttccagtctgagattaatattaatctcttcacaagagatgacccatattccattttagaagaattgtggaaagacgatgaacacacaagaaaatgtggagaaaaccagaacaaacctttaagtcgtgttgtcttcattaacaagaaaacactagctaatgacagcatctttgaatataaggacattggggaaatagttcatgtaaacacacacctggtttcctcaagaaaaagaccccataactgtaactcgtgtggaaagaatttggagcctatcataaccttatataatagaaacaatgcaacagaaaattctgataagactattggagatggtgatattttcactcatttgaattctcatacagaagtgactgcttgtgaatgtaaccaatgtgggaaacctctgcatcataagcaagctctcattcaacaacagaaaattcatactagagagagcctctatttgttttctgactacgtaaatgttttctccccgaagtcacatgcctttgcacatgagagtatttgtgctgaagaaaagcagcatgaatgccatgaatgtgaggcagtcttcactcagaagtcccagcttgatggcagtcagagggtttatgcaggaatatgcactgaatatgagaaggatttttccctcaagtcaaaccgtcagaaaactccttatgaggggaattactataaatgcagtgactatggaagagcctttatccagaagtcagatctgttcagatgccagagaattcattctggagaaaaaccttatgagtacagtgaatgtgagaaaaacctccctcagaattcaaaccttaatatacataaaaaaattcatactggagggaaacactttgaatgtactgaatgtggaaaagctttcacaaggaaatcaacactaagtatgcatcagaaaatccatacaggagaaaaaccttatgtatgtactgaatgtgggaaggcctttatccggaagtcacattttatcacacatgaaagaattcatactggagaaaaaccctatgaatgcagtgactgtgggaaatcctttattaaaaaatcacaactccatgtgcatcagcgaattcacacaggagagaatccctttatatgttcagaatgtgggaaggtcttcactcacaagacaaatctcattatacaccagaaaattcatacaggagaaagaccctatatatgtactgtgtgtggtaaggcctttactgacaggtcaaatctcattaagcaccaaaaaattcatactggagagaaaccttataaatgcagcgactgtggaaaatcattcacctggaagtctcggctcaggatacatcagaagtgtcatactggagagagacattatgaatgcagtgaatgtgggaaagcattcattcagaagtcaacattaagtatgcaccagagaattcatagaggggaaaaaccatatgtttgcactgaatgtggtaaggccttcttccacaaatcccattttattacacatgagagaattcatactggagagaaaccctatgaatgcagtatttgtgggaaatccttcactaagaaatcacagctccacgtacatcagcagattcacacaggagagaaaccctataggtgtgctgaatgtggaaaggcttttactgacagatcaaatctctttacacaccagaaaattcacactggagagaaaccttataaatgtagtgactgtgggaaagccttcactaggaagtcaggtctccatatacatcagcaatcccatactggagaaaggcattatgagtgcagtgaatgtgggaaagcctttgcaagaaaatcaacactaattatgcatcagagaattcatacaggagagaaaccctatatttgtaatgaatgtgggaaatccttcatccagaagtcacacttaaatagacacaggagaattcatactggagagaaaccctatgaatgcagtgactgtggcaagtctttcattaagaaatcacaactccatgagcatcatcgaattcacacaggagagaaaccatatatatgtgctgagtgtggaaaggccttcaccatcagatcaaatcttattaaacaccagaaaattcatactaaacagaaaccctataagtgcagtgacttggggaaagccttaaactggaagccacaactcagtatgcctcagaaatctgacaatggggaagtagagtgctccatgccacaattatggtgtggggactcagaaggtgaccaaggccaactttcttctatctagttagaattatgaacatctggatcatatagctgatgtgtagttacacatatggggagacacttttgagagtgtttaagcaatgtatagtggccatctttggttacttgatattggtgttgtcaagctcctgcaaataatagtaaatgtgcaaggagatga

SEQ ID NO: 202672 - DNA, 2836 bp, Homo sapiens
  Payload ID: 19968
  Gene Name: zinc finger protein 484
  Uniprot ID: Q5JVG2
  ENST ID: ENST00000332591
  CDS Start-End: 227-2677
agcgctgtaagaagtacctctaggcctgggaggcattgagaaaaaggaagtgggtcctgttctggttcttgcgactatagtcacctcccgaggcaaatgaccactgtcctgagaggacgtgggtgaggggcaggaatcagtgtcattcaaggacgtaactgtagacttcagtagggatgagtggcaacaattagaccttgctcagaaaagcctgtacagagaagtgatgctggaaaactatttcaacttgatctcagtgggatgtcaagttcccaaaccagaagtcatcttcagcttggaacaagaagagccatgtatgttggatggtgagatccccagtcagagccgtccagatggggacattggttttggacctttacaacagaggatgtctgaagaagtttctttccagtctgagattaatattaatctcttcacaagagatgacccatattccattttagaagaattgtggaaagacgatgaacacacaagaaaatgtggagaaaaccagaacaaacctttaagtcgtgttgtcttcattaacaagaaaacactagctaatgacagcatctttgaatataaggacattggggaaatagttcatgtaaacacacacctggtttcctcaagaaaaagaccccataactgtaactcgtgtggaaagaatttggagcctatcataaccttatataatagaaacaatgcaacagaaaattctgataagactattggagatggtgatattttcactcatttgaattctcatacagaagtgactgcttgtgaatgtaaccaatgtgggaaacctctgcatcataagcaagctctcattcaacaacagaaaattcatactagagagagcctctatttgttttctgactacgtaaatgttttctccccgaagtcacatgcctttgcacatgagagtatttgtgctgaagaaaagcagcatgaatgccatgaatgtgaggcagtcttcactcagaagtcccagcttgatggcagtcagagggtttatgcaggaatatgcactgaatatgagaaggatttttccctcaagtcaaaccgtcagaaaactccttatgaggggaattactataaatgcagtgactatggaagagcctttatccagaagtcagatctgttcagatgccagagaattcattctggagaaaaaccttatgagtacagtgaatgtgagaaaaacctccctcagaattcaaaccttaatatacataaaaaaattcatactggagggaaacactttgaatgtactgaatgtggaaaagctttcacaaggaaatcaacactaagtatgcatcagaaaatccatacaggagaaaaaccttatgtatgtactgaatgtgggaaggcctttatccggaagtcacattttatcacacatgaaagaattcatactggagaaaaaccctatgaatgcagtgactgtgggaaatcctttattaaaaaatcacaactccatgtgcatcagcgaattcacacaggagagaatccctttatatgttcagaatgtgggaaggtcttcactcacaagacaaatctcattatacaccagaaaattcatacaggagaaagaccctatatatgtactgtgtgtggtaaggcctttactgacaggtcaaatctcattaagcaccaaaaaattcatactggagagaaaccttataaatgcagcgactgtggaaaatcattcacctggaagtctcggctcaggatacatcagaagtgtcatactggagagagacattatgaatgcagtgaatgtgggaaagcattcattcagaagtcaacattaagtatgcaccagagaattcatagaggggaaaaaccatatgtttgcactgaatgtggtaaggccttcttccacaaatcccattttattacacatgagagaattcatactggagagaaaccctatgaatgcagtatttgtgggaaatccttcactaagaaatcacagctccacgtacatcagcagattcacacaggagagaaaccctataggtgtgctgaatgtggaaaggcttttactgacagatcaaatctctttacacaccagaaaattcacactggagagaaaccttataaatgtagtgactgtgggaaagccttcactaggaagtcaggtctccatatacatcagcaatcccatactggagaaaggcattatgagtgcagtgaatgtgggaaagcctttgcaagaaaatcaacactaattatgcatcagagaattcatacaggagagaaaccctatatttgtaatgaatgtgggaaatccttcatccagaagtcacacttaaatagacacaggagaattcatactggagagaaaccctatgaatgcagtgactgtggcaagtctttcattaagaaatcacaactccatgagcatcatcgaattcacacaggagagaaaccatatatatgtgctgagtgtggaaaggccttcaccatcagatcaaatcttattaaacaccagaaaattcatactaaacagaaaccctataagtgcagtgacttggggaaagccttaaactggaagccacaactcagtatgcctcagaaatctgacaatggggaagtagagtgctccatgccacaattatggtgtggggactcagaaggtgaccaaggccaactttcttctatctagttagaattatgaacatctggatcatatagctgatgtgtagttacacatatggggagacacttttgagagtgtttaagcaatgtatagtggccatctttggttacttgatattggtgttgtcaagctcctgcaaataatagtaaatgtgcaaggagatga

SEQ ID NO: 202673 - DNA, 3960 bp, Homo sapiens
  Payload ID: 19968
  Gene Name: zinc finger protein 484
  Uniprot ID: Q5JVG2
  ENST ID: ENST00000395505
  CDS Start-End: 199-2763
atgcgcaaacccaggcagcgctgtaagaagtacctctaggcctgggaggcattgagaaaaaggaagtgggtcctgttctggttcttgcgactatagtcacctcccgaggcaaatgaccactgtcctgagaggacgtgggtgaggggcaggtgagtagagggatggcagcatctgtggactgagcaagaagaatctctgatgtctgtcctgagccttccggaatcagtgtcattcaaggacgtaactgtagacttcagtagggatgagtggcaacaattagaccttgctcagaaaagcctgtacagagaagtgatgctggaaaactatttcaacttgatctcagtgggatgtcaagttcccaaaccagaagtcatcttcagcttggaacaagaagagccatgtatgttggatggtgagatccccagtcagagccgtccagatggggacattggttttggacctttacaacagaggatgtctgaagaagtttctttccagtctgagattaatattaatctcttcacaagagatgacccatattccattttagaagaattgtggaaagacgatgaacacacaagaaaatgtggagaaaaccagaacaaacctttaagtcgtgttgtcttcattaacaagaaaacactagctaatgacagcatctttgaatataaggacattggggaaatagttcatgtaaacacacacctggtttcctcaagaaaaagaccccataactgtaactcgtgtggaaagaatttggagcctatcataaccttatataatagaaacaatgcaacagaaaattctgataagactattggagatggtgatattttcactcatttgaattctcatacagaagtgactgcttgtgaatgtaaccaatgtgggaaacctctgcatcataagcaagctctcattcaacaacagaaaattcatactagagagagcctctatttgttttctgactacgtaaatgttttctccccgaagtcacatgcctttgcacatgagagtatttgtgctgaagaaaagcagcatgaatgccatgaatgtgaggcagtcttcactcagaagtcccagcttgatggcagtcagagggtttatgcaggaatatgcactgaatatgagaaggatttttccctcaagtcaaaccgtcagaaaactccttatgaggggaattactataaatgcagtgactatggaagagcctttatccagaagtcagatctgttcagatgccagagaattcattctggagaaaaaccttatgagtacagtgaatgtgagaaaaacctccctcagaattcaaaccttaatatacataaaaaaattcatactggagggaaacactttgaatgtactgaatgtggaaaagctttcacaaggaaatcaacactaagtatgcatcagaaaatccatacaggagaaaaaccttatgtatgtactgaatgtgggaaggcctttatccggaagtcacattttatcacacatgaaagaattcatactggagaaaaaccctatgaatgcagtgactgtgggaaatcctttattaaaaaatcacaactccatgtgcatcagcgaattcacacaggagagaatccctttatatgttcagaatgtgggaaggtcttcactcacaagacaaatctcattatacaccagaaaattcatacaggagaaagaccctatatatgtactgtgtgtggtaaggcctttactgacaggtcaaatctcattaagcaccaaaaaattcatactggagagaaaccttataaatgcagcgactgtggaaaatcattcacctggaagtctcggctcaggatacatcagaagtgtcatactggagagagacattatgaatgcagtgaatgtgggaaagcattcattcagaagtcaacattaagtatgcaccagagaattcatagaggggaaaaaccatatgtttgcactgaatgtggtaaggccttcttccacaaatcccattttattacacatgagagaattcatactggagagaaaccctatgaatgcagtatttgtgggaaatccttcactaagaaatcacagctccacgtacatcagcagattcacacaggagagaaaccctataggtgtgctgaatgtggaaaggcttttactgacagatcaaatctctttacacaccagaaaattcacactggagagaaaccttataaatgtagtgactgtgggaaagccttcactaggaagtcaggtctccatatacatcagcaatcccatactggagaaaggcattatgagtgcagtgaatgtgggaaagcctttgcaagaaaatcaacactaattatgcatcagagaattcatacaggagagaaaccctatatttgtaatgaatgtgggaaatccttcatccagaagtcacacttaaatagacacaggagaattcatactggagagaaaccctatgaatgcagtgactgtggcaagtctttcattaagaaatcacaactccatgagcatcatcgaattcacacaggagagaaaccatatatatgtgctgagtgtggaaaggccttcaccatcagatcaaatcttattaaacaccagaaaattcatactaaacagaaaccctataagtgcagtgacttggggaaagccttaaactggaagccacaactcagtatgcctcagaaatctgacaatggggaagtagagtgctccatgccacaattatggtgtggggactcagaaggtgaccaaggccaactttcttctatctagttagaattatgaacatctggatcatatagctgatgtgtagttacacatatggggagacacttttgagagtgtttaagcaatgtatagtggccatctttggttacttgatattggtgttgtcaagctcctgcaaataatagtaaatgtgcaaggagatgattggcagtctttcttgtttcactttttgggcaaacagttttataaattcatggctgttgagtttttcatgttctgggtaccacaactattcaatattgacccgcaaaaattcataatgagtagtatgatgagataattttacattgtctaagcagcctaaggacactgagatcaaggcaaagagagggcaatttaggtctataatgaaagtgaatcagcagtttttgtgaaaacactaaagacagaaagaaaggactctactttttttaaaattttctttgggaagtcaccattatttattgttatatctgttggcgtatgctggggcagcagttagccaagaggtctgaaattgctctttgcctatttctcaaaagtctatattattaccttagaactggccctacgatcatggaacttagatacagggacccaggtctagatagcagcactttagatcctcagctttcaccacagaaacctgcacttttttgatgttgttgttaccaactcctgtttgaaaaataggacaaattaagaaaatggatatcaaatcctaaaattttttcccactaattttgttagtacattctctacatgttcgttacttgctagattaccatgagacacaagcatcttgaattttagtttgtgtccttagaagataaaatgtagttgaacatttggaagacttctccttttatctcctcacaatctctacaaactaatcttaattaattttgtttttcaaattctctgtatttgaatagacttttttgtcttttcttctatcaaatactgaaagaactgtgttgtaattttacaaataattgtgaatttgtctcctttagagctactaatttttgctttatatattttgtctttgattttacatacaatttagaattgttgtaatcttcctggttaattgacacattatcattattagatgtttctttttatctctagtaattttttgccttaaatgtactatgtcagatactaatatacatatggattaaaagctaatgtaaatta

SEQ ID NO: 202674 - DNA, 4031 bp, Homo sapiens
  Payload ID: 19968
  Gene Name: zinc finger protein 484
  Uniprot ID: Q5JVG2
  ENST ID: ENST00000395506
  CDS Start-End: 384-2834
atgcgcaaacccaggcagcgctgtaagaagtacctctaggcctgggaggcattgagaaaaaggaagtgggtcctgttctggttcttgcgactatagtcacctcccgaggcaaatgaccactgtcctgagaggacgtgggtgaggggcaggtgagtagagggatggcagcatctgtggactgagcaagaagaatctctgatgtctgtcctgagccttccgatttctgcccctttgtccgaagagccaaaaatgaccaagtccctgacttctttctcaactaccaatggcaggaatcagtgtcattcaaggacgtaactgtagacttcagtagggatgagtggcaacaattagaccttgctcagaaaagcctgtacagagaagtgatgctggaaaactatttcaacttgatctcagtgggatgtcaagttcccaaaccagaagtcatcttcagcttggaacaagaagagccatgtatgttggatggtgagatccccagtcagagccgtccagatggggacattggttttggacctttacaacagaggatgtctgaagaagtttctttccagtctgagattaatattaatctcttcacaagagatgacccatattccattttagaagaattgtggaaagacgatgaacacacaagaaaatgtggagaaaaccagaacaaacctttaagtcgtgttgtcttcattaacaagaaaacactagctaatgacagcatctttgaatataaggacattggggaaatagttcatgtaaacacacacctggtttcctcaagaaaaagaccccataactgtaactcgtgtggaaagaatttggagcctatcataaccttatataatagaaacaatgcaacagaaaattctgataagactattggagatggtgatattttcactcatttgaattctcatacagaagtgactgcttgtgaatgtaaccaatgtgggaaacctctgcatcataagcaagctctcattcaacaacagaaaattcatactagagagagcctctatttgttttctgactacgtaaatgttttctccccgaagtcacatgcctttgcacatgagagtatttgtgctgaagaaaagcagcatgaatgccatgaatgtgaggcagtcttcactcagaagtcccagcttgatggcagtcagagggtttatgcaggaatatgcactgaatatgagaaggatttttccctcaagtcaaaccgtcagaaaactccttatgaggggaattactataaatgcagtgactatggaagagcctttatccagaagtcagatctgttcagatgccagagaattcattctggagaaaaaccttatgagtacagtgaatgtgagaaaaacctccctcagaattcaaaccttaatatacataaaaaaattcatactggagggaaacactttgaatgtactgaatgtggaaaagctttcacaaggaaatcaacactaagtatgcatcagaaaatccatacaggagaaaaaccttatgtatgtactgaatgtgggaaggcctttatccggaagtcacattttatcacacatgaaagaattcatactggagaaaaaccctatgaatgcagtgactgtgggaaatcctttattaaaaaatcacaactccatgtgcatcagcgaattcacacaggagagaatccctttatatgttcagaatgtgggaaggtcttcactcacaagacaaatctcattatacaccagaaaattcatacaggagaaagaccctatatatgtactgtgtgtggtaaggcctttactgacaggtcaaatctcattaagcaccaaaaaattcatactggagagaaaccttataaatgcagcgactgtggaaaatcattcacctggaagtctcggctcaggatacatcagaagtgtcatactggagagagacattatgaatgcagtgaatgtgggaaagcattcattcagaagtcaacattaagtatgcaccagagaattcatagaggggaaaaaccatatgtttgcactgaatgtggtaaggccttcttccacaaatcccattttattacacatgagagaattcatactggagagaaaccctatgaatgcagtatttgtgggaaatccttcactaagaaatcacagctccacgtacatcagcagattcacacaggagagaaaccctataggtgtgctgaatgtggaaaggcttttactgacagatcaaatctctttacacaccagaaaattcacactggagagaaaccttataaatgtagtgactgtgggaaagccttcactaggaagtcaggtctccatatacatcagcaatcccatactggagaaaggcattatgagtgcagtgaatgtgggaaagcctttgcaagaaaatcaacactaattatgcatcagagaattcatacaggagagaaaccctatatttgtaatgaatgtgggaaatccttcatccagaagtcacacttaaatagacacaggagaattcatactggagagaaaccctatgaatgcagtgactgtggcaagtctttcattaagaaatcacaactccatgagcatcatcgaattcacacaggagagaaaccatatatatgtgctgagtgtggaaaggccttcaccatcagatcaaatcttattaaacaccagaaaattcatactaaacagaaaccctataagtgcagtgacttggggaaagccttaaactggaagccacaactcagtatgcctcagaaatctgacaatggggaagtagagtgctccatgccacaattatggtgtggggactcagaaggtgaccaaggccaactttcttctatctagttagaattatgaacatctggatcatatagctgatgtgtagttacacatatggggagacacttttgagagtgtttaagcaatgtatagtggccatctttggttacttgatattggtgttgtcaagctcctgcaaataatagtaaatgtgcaaggagatgattggcagtctttcttgtttcactttttgggcaaacagttttataaattcatggctgttgagtttttcatgttctgggtaccacaactattcaatattgacccgcaaaaattcataatgagtagtatgatgagataattttacattgtctaagcagcctaaggacactgagatcaaggcaaagagagggcaatttaggtctataatgaaagtgaatcagcagtttttgtgaaaacactaaagacagaaagaaaggactctactttttttaaaattttctttgggaagtcaccattatttattgttatatctgttggcgtatgctggggcagcagttagccaagaggtctgaaattgctctttgcctatttctcaaaagtctatattattaccttagaactggccctacgatcatggaacttagatacagggacccaggtctagatagcagcactttagatcctcagctttcaccacagaaacctgcacttttttgatgttgttgttaccaactcctgtttgaaaaataggacaaattaagaaaatggatatcaaatcctaaaattttttcccactaattttgttagtacattctctacatgttcgttacttgctagattaccatgagacacaagcatcttgaattttagtttgtgtccttagaagataaaatgtagttgaacatttggaagacttctccttttatctcctcacaatctctacaaactaatcttaattaattttgtttttcaaattctctgtatttgaatagacttttttgtcttttcttctatcaaatactgaaagaactgtgttgtaattttacaaataattgtgaatttgtctcctttagagctactaatttttgctttatatattttgtctttgattttacatacaatttagaattgttgtaatcttcctggttaattgacacattatcattattagatgtttctttttatctctagtaattttttgccttaaatgtactatgtcagatactaatatacatatggattaaaagctaatgtaaatta

SEQ ID NO: 202675 - DNA, 2054 bp, Homo sapiens
  Payload ID: 19969
  Gene Name: zinc finger protein 485
  Uniprot ID: Q8NCK3
  ENST ID: ENST00000361807
  CDS Start-End: 195-1520
cacttccgcttccggtccagcctgtctccgcgtggtgcgagcgctgcaccagcccctggctggtggttactgtccgaacggcgtggtgtggtcgctgactctctgggcgtgcagctccgcagccctgccggctcggttcgattgacttacgcaggattctcagcccttgcctgggagaacagttcaggagacagatggccccaagagcccagatccagggaccgctgacatttggggatgtggctgtggcctttacccggattgagtggagacacctggatgctgctcagcgggccctgtacagggatgtgatgctggagaactatgggaatctggtgtctgtggggcttctctcttccaaaccaaaactaattactcagttggagcaaggggcagagccctggactgaggtgcgagaggctccatcaggcacacatgcagtcgaggattactggtttgaaacaaagatgtcagccctaaagcaaagcacttctgaagcatctgttctgggagagcgaacgaaaagtgtcatgatggaaaaaggcctggactgggagggcagaagctccacagagaagaactataagtgcaaggaatgtgggaaagtcttcaaatacaattcgtcctttattagccaccagagaaatcacaccagtgagaaaccacataaatgtaaagaatgtgggatcgcctttatgaacagttcatcccttttaaatcaccataaggttcatgcaggcaaacagccttatagatgtattgaatgtgggaagttcctgaagaagcactcaacgtttatcaaccatcagagaattcattctagggagaaaccccacaaatgcattgaatgtggaaaaactttcagaaagaactcaatccttttaagtcatcagagaattcatactggccagaaaccctacaaatgtaatgactgtgggaaagccttcgctcagaatgcagctcttactcgtcatgaaagaatacatagtggagagaagccttttaaatgtaacaagtgtgggagagctttcagggataattcaactgtgttggaacatcagaaaatccatactggtgagaagccatatcagtgtaatgaatgtggaaaagcctttaggaagagctcaactcttattagtcaccaaagaatgcatactggggagaaaccctatcactgcagtaaatgtggaaaatctttcaggtatagctcatcctttgctggtcatcagaaaactcacagtggaaataaaccgtatcagtgtcgtgactgtgggaaggcctttacaaagagctcaacccttactggacatcagagaattcatactggagaaaaaccctatcactgtaagaaatgtgggaaagcctttcggcacagctcaggccttgttgaacatcagagactccatactggggaaaaaccttataaatgtaatgaatgtgggaaagcttttccccgaagttcagcccttaagcaacataagaaaattcataataaagaaagagccatgaaatgtagttagtgtggcaaattgtgcagagtagtttattccttctgaccatcatagaggagacattaaataaattatgcatttaacagaaatactctgtacttctgagagaacacatcacttgtgaggatattcattgtgaggttctactagtgaaatatttgaagaaactaaatgtatgtcagtatggaagtagttatagcatactgtgtgctaattgaaaagaatgaggtggagctgtaaatactgtacaaagccaggcatggtggcatatgcctgtagtcccagttacttgggaggctgagacaggattgcttaagcccaggagtttgagtctgtaatgcactatgattgtgcatgtgaatagccactgcactccagcctgggcaacatagcaagactccatctctaagtaaaaaaatacaacagtagaaatatacccatgataatatacccaatatacccttgttaaagaagcaagtttcaggaaatctatattatatgcattcaaaaagacctggacaaataaagaccaatcttaacagc

SEQ ID NO: 202676 - DNA, 2052 bp, Homo sapiens
  Payload ID: 19969
  Gene Name: zinc finger protein 485
  Uniprot ID: Q8NCK3
  ENST ID: ENST00000374435
  CDS Start-End: 193-1518
gcctgtctccgcgtggtgcgagcgctgcaccagcccctggctggtggttactgtccgaacggcgtggtgtggtcgctgactctctgggcgtgcagctccgcagccctgccggctcggttcggttcgtgagcggccgggattgacttacgcaggattctcagcccttgcctgggagaacagttcaggagacagatggccccaagagcccagatccagggaccgctgacatttggggatgtggctgtggcctttacccggattgagtggagacacctggatgctgctcagcgggccctgtacagggatgtgatgctggagaactatgggaatctggtgtctgtggggcttctctcttccaaaccaaaactaattactcagttggagcaaggggcagagccctggactgaggtgcgagaggctccatcaggcacacatgcagtcgaggattactggtttgaaacaaagatgtcagccctaaagcaaagcacttctgaagcatctgttctgggagagcgaacgaaaagtgtcatgatggaaaaaggcctggactgggagggcagaagctccacagagaagaactataagtgcaaggaatgtgggaaagtcttcaaatacaattcgtcctttattagccaccagagaaatcacaccagtgagaaaccacataaatgtaaagaatgtgggatcgcctttatgaacagttcatcccttttaaatcaccataaggttcatgcaggcaaacagccttatagatgtattgaatgtgggaagttcctgaagaagcactcaacgtttatcaaccatcagagaattcattctagggagaaaccccacaaatgcattgaatgtggaaaaactttcagaaagaactcaatccttttaagtcatcagagaattcatactggccagaaaccctacaaatgtaatgactgtgggaaagccttcgctcagaatgcagctcttactcgtcatgaaagaatacatagtggagagaagccttttaaatgtaacaagtgtgggagagctttcagggataattcaactgtgttggaacatcagaaaatccatactggtgagaagccatatcagtgtaatgaatgtggaaaagcctttaggaagagctcaactcttattagtcaccaaagaatgcatactggggagaaaccctatcactgcagtaaatgtggaaaatctttcaggtatagctcatcctttgctggtcatcagaaaactcacagtggaaataaaccgtatcagtgtcgtgactgtgggaaggcctttacaaagagctcaacccttactggacatcagagaattcatactggagaaaaaccctatcactgtaagaaatgtgggaaagcctttcggcacagctcaggccttgttgaacatcagagactccatactggggaaaaaccttataaatgtaatgaatgtgggaaagcttttccccgaagttcagcccttaagcaacataagaaaattcataataaagaaagagccatgaaatgtagttagtgtggcaaattgtgcagagtagtttattccttctgaccatcatagaggagacattaaataaattatgcatttaacagaaatactctgtacttctgagagaacacatcacttgtgaggatattcattgtgaggttctactagtgaaatatttgaagaaactaaatgtatgtcagtatggaagtagttatagcatactgtgtgctaattgaaaagaatgaggtggagctgtaaatactgtacaaagccaggcatggtggcatatgcctgtagtcccagttacttgggaggctgagacaggattgcttaagcccaggagtttgagtctgtaatgcactatgattgtgcatgtgaatagccactgcactccagcctgggcaacatagcaagactccatctctaagtaaaaaaatacaacagtagaaatatacccatgataatatacccaatatacccttgttaaagaagcaagtttcaggaaatctatattatatgcattcaaaaagacctggacaaataaagaccaatcttaacagc

SEQ ID NO: 202677 - DNA, 529 bp, Homo sapiens
  Payload ID: 19969
  Gene Name: zinc finger protein 485
  ENST ID: ENST00000430885
  CDS Start-End: 178-529
cggtccagcctgtctccgcgtggtgcgagcgctgcaccagcccctggctggtggttactgtccgaacggcgtggtgtggtcgctgactctctgggcgtgcagctccgcagccctgccggctcgattgacttacgcaggattctcagcccttgcctgggagaacagttcaggagacagatggccccaagagcccagatccagggaccgctgacatttggggatgtggctgtggcctttacccggattgagtggagacacctggatgctgctcagcgggccctgtacagggatgtgatgctggagaactatgggaatctggtgtctgtggggcttctctcttccaaaccaaaactaattactcagttggagcaaggggcagagccctggactgaggtgcgagaggctccatcaggcacacatgcagtcgaggattactggtttgaaacaaagatgtcagccctaaagcaaagcacttctgaagcatctgttctgggagagcgaacgaaaagtgtcatgatggaaaaaggcc

SEQ ID NO: 202678 - DNA, 3837 bp, Homo sapiens
  Payload ID: 19970
  Gene Name: zinc finger protein 486
  Uniprot ID: Q96H40
  ENST ID: ENST00000335117
  CDS Start-End: 58-1449
agaggcccaccctctgtggccctgtgtcctgtaggtattgggagatccacagccaagatgccgggaccccttagaagcctagaaatggaatcattgcaatttagagatgtggctgtagaattctctctggaggagtggcattgcctggacactgcacagcagaatttatatagggatgtgatgttagagaactacagacacctggtcttccttggtattattgtctctaagccagacctgatcacctgtctggagcaaggaataaaacctctgactatgaagagacatgagatgattgccaaacccccagttgtgtgttctcattttgcccaagacctttggccagagcagagcataaaagattcttaccaaaaagtgatactgagaaaatttgaaaaatgtggacatggcaatttacactttaaaaaaggctgtgaaagtgtggatgagtgtaagttacacaaaagaggttataatggacttaaccaatgtttgacaactacccagagcaaaatatttcaatgtggtaaatatgtgaaagtctttcatcaattttcaaattcaaagagacataaaagaagacatactgaaaaaaaacctttgaaatatatagaaggtgacaaagcttttaaccagtcctcaacccatactacacataaaaaaattgatactggagagaaaccatacaaatgtgaagaatgtggcaaagccttcaaccggtcctcacaccttactacacataagataactcatactagagagaaaccctacaaatgtgaagaatgtggcaaagtctttaagtacttctctagctttactacacataagaaaattcatagtggagagaaaccctacatttgtgaagaatgtggcaaagcctttatgtacccctatacccttactacacataagataatccatactggagagcaaccctacaaatgtaaagaatgtgacaaagcttttaaccatcctgcaactctttcttcacataagaaaattcatactggagagaaaccgtacacgtgtgataaatgtggcaaagcctttatttcatcctcgatccttagtaaacatgagaagattcatacgggagagaaaccctacaaatgtgaagaatgtggcaaagccttcacccgctcctcacaccttactatgcataagataattcatactggagagaaaccatacaaatgtgaagaatgtggcaaagcctttacatggtctgcaggcctccataaacataggagaactcatactggagagaaaccctacaaatgtgaagaatgtggcaaagcgtatactacatcctcaaatctaactgaacataagacaactcatactggagagaaaccttacaaatgtaaagaatgtggcaaagcttttaactggtcctcagaccttaataaacataagagaattcatattggacagaaaccaagaacgtgacaaaggattattttattattattatttttttgagaggtaattctgctgttgtttcccaggctggagtgcaatggcataattttggctcaccacaacctccaccttctgggttcaagtaactctccttagtagctaggattacagggctgcaccaccacacctggctaattttgtatttttagtagagatggggtttctccatgttggtcaggctggtctcaatctcctaacctcaggtggtctgcctgctttggcctcccaaagtgttggggttacaggcatgagccactgtgcctggctgacaaagctttttaaggaagttctcaacccttattacacataattcatactggacagaaaccctacaagtgtgaagaatgtggcaagcctgtaacaagttctcaattcttttatttttatttgtttatttattttttgagatgcagtttcactcttgtgacccgggctgtagtgcaatggcatgatcttggcttactgtgacctctgcctcctgggttcaagccattctcctgcctcagcctcccaagtagctgggattacaggtgccaccaccattcccagctaatttttgtatttttagtagagatgggcttttgccatatttgccaggctggtctcaaactcctgacctcaggtgatccactcgcctcggcttcctaaagtgctgggatgacaggcatgagcctcaattcccagccataagctcttaattcttaagagacatggcgataattcatggtgaagaggaactttacaaacctgaaagatgtgacagtgcttttcccaacacctccaacttttctatgcataaaaaaaattatactacaccatagaaatgtatgaaatgtgacaaagcctttatatggttgccacactttattgtaggtaattcatacttccaaaatacctacaagtatgaagaatgtggcaaaacttttaatcagtgcttacaccgtatttcacaggaaagctattatccttgagaaaaattgtacaaatataaagaatatggaaaagccattaatgtccatcacatcttactcaacagaagaaggttcataaaagagcaattactgtgacaaaaatctttcagaaaatataagcctttaaggtgaagaagagtattgattctgaagacaagcattacaaatataaagaggtttgtagtacctttgcttgtattacagatcttattgcccgcgttttgtattagaaggaaaccctaaagcggttgccaaactttgtgcaacatcagggaatgtatattgaagaagattcctgcaaatgtaatgagtttggaaacacttcttagataaattatttgtggctgggcacagtggctcatgcctgtaatcccagcactttgggaggccaaggtgggaggatcacctgatgtcgggagtttgagatcagactgaccaaaacggagaaacccagtctctactgaaaatataaaattagccatgcatggtggcacatgcctgtaatcccagctactcaggaggcttgaaccctggaggcagaggttgtggtgagtcgagatcattgcactccagcctgggcaataagagtgaaactctgtctccaggaaaaaaaaaaatttatttgtgtataactttaaaagcagatttttggaagcattgtaattacattaaaagtatacttgttccagctgcgtgtggtggctcatgcctgtaatcccaacactttgggaggccaaggcaggtggatcacgaggtcaggagttcaagaccatcttggccaagatggtgaaaccctgtctgtactaaaaatacaaaaattagccatgcatggtggccggcgcgtataatcccagctgcttgggaggctgaggcagagaattggaattgcttgaacctgggaggtggaggttgcagtgagccgaggttgcaccattgtccagcctgggcaacagagcaagactccatctcaaaaaaaaaagtgtatttgtttccttaaaaaaatttttctgaaaagtgggtaatgacataatacagctttcaaattactttatgctgttattttattcttattgtattcacatgtgaaagcatgtgatcaatttttgctgcatcagagatattagagatagttttttattaattgggcatttatgaccttttctataaaagtaaggacattaaaatgtaagatgcatgatgaaaatataagtggagaggctctttgtagttaacctatatgaagtaatgtataaggtaggtcagagtaatacttttctacattatagtgcaagaaataattattgataaaagtatattaaactaaattcgtatattttacttattgtacttttatgtaataaaatgcagtgcatttaaaaattgt

SEQ ID NO: 202679 - DNA, 734 bp, Homo sapiens
  Payload ID: 19970
  Gene Name: zinc finger protein 486
  ENST ID: ENST00000597083
  CDS Start-End: 104-490
ctggagctctaggtcgcctcttcgctactctgtgtcctctgctcctagaggcccaccctctgtggccctgtgtcctgtaggtattgggagatccacagccaagatgccgggaccccttagaagcctagaaatggaatcattgcaatttagagatgtggctgtagaattctctctggaggagtggcattgcctggacactgcacagcagaatttatatagggatgtgatgttagagaactacagacacctggtcttccttggtattattgtctctaagccagacctgatcacctgtctggagcaaggaataaaacctctgactatgaagagacatgagatgattgccaaacccccagggccaggcatggttgtggctcccatctgtaatcccaggattttgggaggccaacacaggaggatccctggagcccaaaagtttgagaccagcctgggaaagatatggagacccctctttataaaaataatttaataattgccaggcatggtggtatgcagctgtggtacctgctacttgggagatggagggggagtcaaaattgtgccactacactccagcttgaatgacagagtgagaccctgtctccaaaaaacaaaaaaaagctgttcatttcaggcatgttaagtatattctcattgttatgtaaaatacttctagacactttacatcttgtaaaactaaaactcaatacccattaaataacaactgctcattt

SEQ ID NO: 202680 - DNA, 568 bp, Homo sapiens
  Payload ID: 19971
  Gene Name: zinc finger protein 487
  ENST ID: ENST00000315429
  CDS Start-End: 1-568
cgcggccccgcccccggacgcccagccgcggtcccagcgaccttcgctttcgtggggaagccggactgcgccgtgtcttcctgaagaaggctgggggatcagtgtccttcagtgatgtggctgtgggcttcacccaggaggagtggcagcatctggactctgctcagaggaccccgtacagagacatgatgctggagaactacagcctcctcctctcagtgggatattgcattaccaaaccagaggtggtttgcaagttggagcatggacaggtgctgtggatattagaggaagagtccccaagtcagagccacctagactgctgcatagatgatgacctgatggagaagagacaggaaaatcaagaccagcatttgcagaaagttgattttgtcaacaataaaacactgactatggacagaaatggtgtattaggaaaaacattttctcttgacacaaaccccattctatcaagaaaaatacgtggcaactgtgactcatctggaatgaatttgaataatatttcagaattaattattagtaatagaagctcctttgtaaggaaccc

SEQ ID NO: 202681 - DNA, 2111 bp, Homo sapiens
  Payload ID: 19971
  Gene Name: zinc finger protein 487
  Uniprot ID: B1APH4
  ENST ID: ENST00000437590
  CDS Start-End: 228-854
agtttccatggtgagatggtcaacaagcctgtaagttcctcagctacgactaccaggtacctcgggttcctccctcctccgagagaccgccgaggtgcgggctgtgagagggggagcgtggagcctccgaggccgagggatcagtgtccttcagtgatgtggctgtgggcttcacccaggaggagtggcagcatctggactctgctcagaggaccccgtacagagacatgatgctggagaactacagcctcctcctctcagtgggatattgcattaccaaaccagaggtggtttgcaagttggagcatggacaggtgctgtggatattagaggaagagtccccaagtcagagccacctagactgctgcatagatgatgacctgatggagaagagacaggaaaatcaagaccagcatttgcagaaagttgattttgtcaacaataaaacactgactatggacagaaatggtgtattaggaaaaacattttctcttgacacaaaccccattctatcaagaaaaatacgtggcaactgtgactcatctggaatgaatttgaataatatttcagaattaattattagtaatagaagctcctttgtaaggaaccctgctgagtgtaatgtacgtgggaaatttctcctctgtatgaagcgtgagaatccttatgccagagggaaacctttggaatatgatggaaatgggaaagccgtctctcagaatgaggacttatttaggcatcagtatattcaaactcttaagcagtgttttgaatacaatcagtgtgggaaggcttttcatgaagaggcagcctgcagtacccataagagagtgtgctcatgggagaccctgtgaatataatgaacatgtgagagccttttccgatagaccaatattcattgttcatcagagaactcacataaggaagagtcaccatgaattcaatgaatgtgagaggaggtctggtgagaggccacctgtaaataaacaccacagggttatggagatgaaatactatgagtgtaatgcgagtgagaatagttttggcaagaaatcactcctcattctacaaagttacagaggagagaaaacttgactgtagtagacatttggaagtattctgcaagaagccaaatttcactcaacatcaagaaacacatataggaaagaatgcctataaaattaatcagtatgctagtacattttgctgtaagccaaagcattctgtatatcagaaaacagatacagaagaaaaactctatgaatgtagtgaatgtgggaaaaccttcagccataaatcctcttttatcctacagcagaggatacacagaggagagaaaccctatgaatgcactgaatgtgggaaaacttttggatataggtcatgccttgcagtacatcaaagaacacacacgggacaaaacctatgaatgtaatgaatgtggaaaaaacttctgtgagaagtcaaatcttcatgtacatcagagaacacacacaggagagaaaccctatggatgtaatgaatgtcagaaagcctttggtgataggtcagctctaaaagtacatcagagaatacatactggcgagaaaccctatgagtgtaaggaatgtgggaaaactttctcccagaagccaaacttcattaatcatcagtgaactcacacaggagagagaccctttgaatgcaatgaatgtcaaaaatccttctctgtgaagtcaaaacttagagaacatcagagaattcacacaggggagaaaccctatgaatgtaatgaatgtgagaaaatgttctaccacaagtcatccctcacagtacatcagagaacccacacaggagagaaaccctatgcatgtagtgaatgtgggaaaaccttctaccagaagtcatccctcacaacacatcagagaacacacacaagggagcaaccctatgaatataatgaaagcttttaccagaatcccaacttcactaaatgtcagagagacaacatagaggaaacccttgtcaacatcctgaaggctcagaaaccttcaccttcttggactcgttccatagcagaaacaacccaggttggggtgagaacacccaataaagatgagaaatcttttgcc

SEQ ID NO: 202682 - DNA, 240 bp, Homo sapiens
  Payload ID: 19971
  Gene Name: zinc finger protein 487
  ENST ID: ENST00000451167
  CDS Start-End: 221-240
aagttcctcagctacgactaccaggtacctcgggttcctccctcctccgagagaccgccgaggtgcgggctgtgagagggggagcgtggagcctccgaggccgagaatgaaaacaaatgtactgttctagggatcagtgtccttcagtgatgtggctgtgggcttcacccaggaggagtggcagcatctggactctgctcagaggaccccgtacagagacatgatgctggagaactacag

SEQ ID NO: 202683 - DNA, 567 bp, Homo sapiens
  Payload ID: 19971
  Gene Name: zinc finger protein 487
  ENST ID: ENST00000456416
  CDS Start-End: 228-567
agtttccatggtgagatggtcaacaagcctgtaagttcctcagctacgactaccaggtacctcgggttcctccctcctccgagagaccgccgaggtgcgggctgtgagagggggagcgtggagcctccgaggccgagggatcagtgtccttcagtgatgtggctgtgggcttcacccaggaggagtggcagcatctggactctgctcagaggaccccgtacagagacatgatgctggagaactacagcctcctcctctcagtggactgctgcatagatgatgacctgatggagaagagacaggaaaatcaagaccagcatttgcagaaagttgattttgtcaacaataaaacactgactatggacagaaatggtgtattaggaaaaacattttctcttgacacaaaccccattctatcaagaaaaatacgtggcaactgtgactcatctggaatgaatttgaataatatttcagaattaattattagtaatagaagctcctttgtaaggaaccctgctgagtgtaatgtacgtgggaaatttctcctctgtatgaagcgtgagaatc

SEQ ID NO: 202684 - DNA, 3496 bp, Homo sapiens
  Payload ID: 19972
  Gene Name: zinc finger protein 488
  Uniprot ID: Q96MN9
  ENST ID: ENST00000585316
  CDS Start-End: 163-1185
ggaggaggctgtgctgcaccagcacctcttgctccacatctccagagagcccagggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagggcgggccgggatgtgggcagtgcggagctggcactgttggtagccccaggcaagccccgacctggcaagccgctgcccccgaagacacgtggagagcagaggcagagcgccttcacggagctgccgaggatgaaggaccggcaggtggatgctcaggcccaggagagggagcacgatgaccccacaggccaacctggtgccccacagctgacccagaacatccccagaggcccagctggcagcaaagtcttctctgtgtggcccagcggagcacgaagtgagcaaagaagcgcctttagcaaaccaaccaagcgaccagcagagaggcctgagctaacctcagtcttccctgcaggggaatctgcagatgccctgggggagctgtctggactcctcaacactacagacctcgcttgttggggtcgactttcaactcccaagcttttggttggtgatttgtggaacttgcaagcattgccacagaatgctccactctgtagcacttttctgggtgcccctacactgtggctggagcatacccaggcccaggtgcccccaccctcatcatcctccaccacttcgtgggccctcctgccacccaccctcacctccctgggcttgtccacccagaactggtgtgcaaagtgcaacctgtcctttcgcctaacgtccgacctggtctttcacatgcgatcccaccacaaaaaggagcatgcggggcctgacccacattctcagaagcggagagaagaggcccttgcctgccctgtgtgccaggagcacttccgggagcgccaccacctctcccggcacatgacttctcacagctagcaggtgaccgcagaatgacctgctgggtgcagcagccagcctttggcagaggggggctccctgggcctgcgttgagggggctgtcatggtcctttgcagagctgctgcttttggcattcatagataaacagctcaggcataatttgaaaaagccacacctgcatgatgtgttttgaaggaaatgaagtcctgaaataaagtgatgggctttgcaaatccagggtagaggccctaacaggcacagagagcaggggcaactcctggcacacatcatgggctttggaggcacacaagcctggattcgaatctgggctctttcacatactagctgtgaccctggacaaagagctttaacctgctgagtccccattttctcatctgtgaaatggagatgataacactgtgtcttaggttggcattcaggtcacatgaaaggtgtgtggaaagtggccagcattctgcctgcagaccctgagcactgagtcaacaaggtttgtgatgatgtctgtactagttagctattgttattaacaagatctccatggcagacaagctaaagcatctgcctaagtcgtgagtctgtgggttggctcaggttaagctgagcttggctgggcttggcagcaagtctcagatttgatcaagtcatattcgttttcttcttcggctggtgggctacccagagcgagcacgcttctctcgtggtcatgccaagaacacaggagggtgagtctaacaagcacacctcaagcctctgcttgggtcacattgccaatgtcctctcagcccatacaagtggcaggaccaggcccaatattaaggagtggaaaagtgtaggctgcccttggtgaagctgtgacaagggagtgaccatccatcccctccacaggagggtgaggaattgggacaggtaattccagccaatacctggtccatagttcttcacattgtgagtatatgaatacggggaaatagaaccccctccccaccacctacacacatgctgttttaccttccaagaataggacatgtgcaaaaactaggcttccagatcgtgaggctggggagcattctaggtaccatttattatctactgcgtttcggtcagtagctgttgtaggtacccgcatcagcccttgttcctaaggatgtgtggagcccaggctgtactctttgacattccacaggtcagtctgcgtgaaagccctttgtggggagtttccaagccagtgtcgtttttgcactggtttccacctcactgtcagatattgttcttttgatatgcagtttccagccctccaatgagtccccagcacagatctcaggcttgtggctgggaataagcccagctgagcaggtggggatctcagccagcctcccagactgcacctcttctattgctctcctctgtccaccgttccaggcagcagcactcccacctggctgctctgatgtcctcgctccctccattcctgcctctcaccatgcacgcatccattgtccacacacacacaaccagataatcttctgaaagtgtaactcagatgatgcctccaaccctgtggctgcccttcacacttacaggcctaaccccagcaggacctgccagctgcttcatgaacaagtccctgcctcatgttaattgcaagcactcatttcactctccctgtgtgccaggcaatagcataagcactggaagaatacagatgttatagtgagtcctacaatagccctggaaggcaagagctgtttcctttccatttctacaatgagtcaattgcagatgatgctataacacttccagtgtttctgacacttccctgaagctatacctgctaccttcatgggccgagcttgcccttatgaggcccacaggtggcagtgggcagaggggaccccgctataccacctcgctgctgttccactgtctgctcccgtgttctgaccacagctctggtgccgtttctcaagcctgggcttcattcaacattttctatctagctcttcatggtgctgctcctgctatggttccacagggcttcttctcgcaggtcagctccttagagaggtctcccagattccccgtaaagcagccctgcagcctctgcctctctcagccgcatcaccctgttgcttccttcacagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtggaaataa

SEQ ID NO: 202685 - DNA, 3372 bp, Homo sapiens
  Payload ID: 19972
  Gene Name: zinc finger protein 488
  Uniprot ID: Q96MN9
  ENST ID: ENST00000591025
  CDS Start-End: 366-1067
gctgcaccagcacctcttgctccacatctccagagagcccagggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagagcgccttcacggagctgccgaggatgaaggaccggcaggtggatgctcaggcccaggagagggagcacgatgaccccacaggccaacctggtgccccacagctgacccagaacatccccagaggcccagctggcagcaaagtcttctctgtgtggcccagcggagcacgaagtgagcaaagaagcgcctttagcaaaccaaccaagcgaccagcagagaggcctgagctaacctcagtcttccctgcaggggaatctgcagatgccctgggggagctgtctggactcctcaacactacagacctcgcttgttggggtcgactttcaactcccaagcttttggttggtgatttgtggaacttgcaagcattgccacagaatgctccactctgtagcacttttctgggtgcccctacactgtggctggagcatacccaggcccaggtgcccccaccctcatcatcctccaccacttcgtgggccctcctgccacccaccctcacctccctgggcttgtccacccagaactggtgtgcaaagtgcaacctgtcctttcgcctaacgtccgacctggtctttcacatgcgatcccaccacaaaaaggagcatgcggggcctgacccacattctcagaagcggagagaagaggcccttgcctgccctgtgtgccaggagcacttccgggagcgccaccacctctcccggcacatgacttctcacagctagcaggtgaccgcagaatgacctgctgggtgcagcagccagcctttggcagaggggggctccctgggcctgcgttgagggggctgtcatggtcctttgcagagctgctgcttttggcattcatagataaacagctcaggcataatttgaaaaagccacacctgcatgatgtgttttgaaggaaatgaagtcctgaaataaagtgatgggctttgcaaatccagggtagaggccctaacaggcacagagagcaggggcaactcctggcacacatcatgggctttggaggcacacaagcctggattcgaatctgggctctttcacatactagctgtgaccctggacaaagagctttaacctgctgagtccccattttctcatctgtgaaatggagatgataacactgtgtcttaggttggcattcaggtcacatgaaaggtgtgtggaaagtggccagcattctgcctgcagaccctgagcactgagtcaacaaggtttgtgatgatgtctgtactagttagctattgttattaacaagatctccatggcagacaagctaaagcatctgcctaagtcgtgagtctgtgggttggctcaggttaagctgagcttggctgggcttggcagcaagtctcagatttgatcaagtcatattcgttttcttcttcggctggtgggctacccagagcgagcacgcttctctcgtggtcatgccaagaacacaggagggtgagtctaacaagcacacctcaagcctctgcttgggtcacattgccaatgtcctctcagcccatacaagtggcaggaccaggcccaatattaaggagtggaaaagtgtaggctgcccttggtgaagctgtgacaagggagtgaccatccatcccctccacaggagggtgaggaattgggacaggtaattccagccaatacctggtccatagttcttcacattgtgagtatatgaatacggggaaatagaaccccctccccaccacctacacacatgctgttttaccttccaagaataggacatgtgcaaaaactaggcttccagatcgtgaggctggggagcattctaggtaccatttattatctactgcgtttcggtcagtagctgttgtaggtacccgcatcagcccttgttcctaaggatgtgtggagcccaggctgtactctttgacattccacaggtcagtctgcgtgaaagccctttgtggggagtttccaagccagtgtcgtttttgcactggtttccacctcactgtcagatattgttcttttgatatgcagtttccagccctccaatgagtccccagcacagatctcaggcttgtggctgggaataagcccagctgagcaggtggggatctcagccagcctcccagactgcacctcttctattgctctcctctgtccaccgttccaggcagcagcactcccacctggctgctctgatgtcctcgctccctccattcctgcctctcaccatgcacgcatccattgtccacacacacacaaccagataatcttctgaaagtgtaactcagatgatgcctccaaccctgtggctgcccttcacacttacaggcctaaccccagcaggacctgccagctgcttcatgaacaagtccctgcctcatgttaattgcaagcactcatttcactctccctgtgtgccaggcaatagcataagcactggaagaatacagatgttatagtgagtcctacaatagccctggaaggcaagagctgtttcctttccatttctacaatgagtcaattgcagatgatgctataacacttccagtgtttctgacacttccctgaagctatacctgctaccttcatgggccgagcttgcccttatgaggcccacaggtggcagtgggcagaggggaccccgctataccacctcgctgctgttccactgtctgctcccgtgttctgaccacagctctggtgccgtttctcaagcctgggcttcattcaacattttctatctagctcttcatggtgctgctcctgctatggttccacagggcttcttctcgcaggtcagctccttagagaggtctcccagattccccgtaaagcagccctgcagcctctgcctctctcagccgcatcaccctgttgcttccttcacagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtgg

SEQ ID NO: 202686 - DNA, 4237 bp, Homo sapiens
  Payload ID: 19973
  Gene Name: zinc finger protein 490
  Uniprot ID: Q9ULM2
  ENST ID: ENST00000311437
  CDS Start-End: 124-1713
cgcttccgccggtgggacggaactggtgccctccgtggacaattgtgttgaagcagaaattgttccggatctcgggtcggacacggaagtcttcctgcagtgtttctggatgcggggacagggatgcgcaggaattccagtctcagtttccagatggagcgacccctcgaggagcaagtccagagcaagtggtcgtctagtcaaggccgcacaggaacaggagggtctgatgtcctccagatgcagaacagtgaacaccatggacaaagcatcaagactcaaactgactccatctcccttgaggatgtggctgtgaacttcaccctggaggagtgggctttgctggatcctggccagaggaatatctacagagatgtgatgcgggcaaccttcaagaacctggcctgtataggggaaaaatggaaagaccaggatattgaagatgaacacaaaaaccagggaagaaatctaagaagtcctatggttgaagcactctgtgaaaataaagaagattgtccatgtggaaaaagcactagccagattcctgatcttaatacgaacctggaaactcctactggattaaaaccatgtgactgcagtgtgtgtggggaagtcttcatgcatcaggtctcccttaataggcacatgagatctcacactgaacagaaaccaaatgagtgtcacgaatatggagagaagccacataaatgcaaagaatgtgggaaaaccttcactcgcagctccagtattcgaacccatgaaagaattcacactggagagaaaccctatgaatgtaaggaatgtggcaaagccttcgcatttctcttttcctttcgaaaccatataagaattcatactggagagacaccctatgaatgtaaggaatgtgggaaggcattcagatatctcactgctcttcggcgccatgaaaaaaatcacactggagagaaaccctacaaatgtaaacagtgtggaaaagcctttatatattaccagccttttctaacccacgaaaggactcacactggagagaaaccttatgaatgtaagcaatgtgggaaagccttcagttgtcccacgtacttacggagtcatgagaaaactcatactggagagaaaccttttgtatgtagggaatgtgggagagccttcttttctcactcaagccttcgaaaacacgtgaaaacccacaccggagttcaaccttatacatgtaagaaatgtggggaagccttcaagtcatctagttcctgtgaagtgcacgaaagaactcattttggagaaaaaccctatgaatgtaaacaatgtggtaaagccttcaattcttcaagttaccttcagttgcacgaaagagttcacactggcgagaaaacttacgaatgtaaagaatgtggtaaagcctttctttattccactcactttcgaatccatgaaagaacccatactagagagaaaccctatgaatgcaaacagtgtggtcgggtcttcatttacttcagtcaccttcgaaggcacgaaagaagtcacactggagtgaaaccatgtgagtgtaagcagtgtggcaaagctttcacttgtttaaattccctgaaagtacacaaaagaattcatactggagaaagaccctttcagtgtagacaatgtggtaaagccttcagttactcaaagtctttgcacgtgcacgaaaggactcatagtagacagaagccctaagaaagtaaagtgtggtaatgctgtcagttgtattagttccttttggatgtatgagagtacttacgctggagagaaattcaaggaatgtaaacggtgtgattaagccttcagttgtcctaattccctttgaagacgtgactcatgcggcaatgaaatatttaacaaatgggggaggaacttgcactctcctgcgggattgcagatatgtgaatggactccatggacagaaaagctacgaatgtatggagtgtaggaaagccttcacttcacgtaatcttttaaagacacctgagaatatatactggagagaaactataaagaaaattctatatccatcccatcttttgtggggtttgttttttgtttttgtttttgttgagatgtaattttgctcttgttgcccaggctggagtgcagtggtgcgatcgcggctcaccgcaacctccgcctcccggattcaagcaattctcctgccgcagcctcccaagaagctgggattacaggcatgcgccaccacgcctggctaattttgtaattttagtagagatggggtttctccatgttggtcaggctggtctcaaactcctgacctcaggtgatctgcctgcctcggcctcccaaagtgctgggattacaggtgtgagccacagcacccaacctttttttccccgccgcaccccaagatggtgtctcactctgttgccccaggctggagtgcagtggtgtgatcctggctcactgtaacctctgggttcaagcaattcttctgcctcagccttccaagtagctgggattacaagtgcccaccaccatgcccagctaatttttatatttttagtagagacagtgtttcaccatgttgaccaggctgatcttaaactcttgacctcaaatgatccacccaccttggcctcccaaattgttcgttttacttttttttttttttttttttgagctggagtcttactctgttgcctaggctggagtgaaagtggcgcaacctctgcctcccaggtcaaagcaatcctgcctcaggccccctagtagctggcattacaggcacatgccaccacgcccaactaatttttatatttttagtagagacggggtttcaccatgttggccaggctggtcttgaactcctgacctcaggtaatccacctgccttggcctcccaaagtgctgggattacaggcgtgagccaccacacccggcccccagttctttttttttttttttgagacggagtccttgcccaggctggagtgcagtggcgcgatctcagctcactgcaagctccgcctcctgggttcacgccattctcctgcctcagcctcccgagtagctgggactacaggcgcccgccaccacgcccggctcattttttgtatttttagtggagacggggtttcaccgtgttagccaggatagtcttgatctcctgacctcgtgatccgccctcctcggcctcccaaagtgctgggattataggcgtgagccaccgcgcccggcctccagttcattttaaaaccatgaaaccacccacactggagagccaccttcttaaatgtaagcaatatgggaacatcttcaatgacatctgcaaccattgtcgagattcttcgtaggaagaattaaaggaatggggaagaaggacttgggccccagcaggccttttgtggcatccagtcagaagttaggaaacaccctctagggcagtgcctgccctcagctctcacacatgactggagagaagtgagaagactcccagaatctgccttttaagtttccatcagtgtcctcgggtcagactgtgggaatgctgtacttctaagacaaaggttcgcatcttacagtttttccccaagtgggatctgcctatgcacatcctaattcacagacattgtcagcattgcattattccagggctgttttgaggtcatctccagctccatttcccatctcaaacctacactttggacacttgtttaaacattcacatctgaatttctctgtggcaaccgcaggtggctctgaggtgagagactgaagaagcagagcctgtatcatgggacacacaccccttgaccacacagcatccactctcctgcggttaccagccctgcaccaaccaccacagtcagaataatctcaaaactgctagtggagtcacagacacactctgccatgtcttagctgtaggacactcagaattcttacctcccctaacttgctttccctgttttctggcacattctaccctgagatattcagcggcatatgcactgatgatgctccggccttctcacgtcagtgcatgtcacatgcatcctgctccaggactggtttcctagcctcccgctaagactagcacttagctcttcttggaaaaggacccaccctgcagcgctccagctctgttgtgtatgggaggtgctggtgtcagggttcacaagccatggaactaccttgcttcacatcacaaggcaaggtgaactcaactcccaataaactgcttgctgga

SEQ ID NO: 202687 - DNA, 996 bp, Homo sapiens
  Payload ID: 19973
  Gene Name: zinc finger protein 490
  ENST ID: ENST00000414906
  CDS Start-End: 124-306
cgcttccgccggtgggacggaactggtgccctccgtggacaattgtgttgaagcagaaattgttccggatctcgggtcggacacggaagtcttcctgcagtgtttctggatgcggggacagggatgcgcaggaattccagtctcagtttccagatggagcgacccctcgaggagcaagtccagagcaagtggtcgtctagtcaaggccgcacaggaacaggagggtctgatgtcctccagatttatggttacaaatgcacttgtgttacgtggatatatttcatagtggcgaagtctggcttttagtgcacccatcacccaaagagtgtatattgtacccaatagatgcagaacagtgaacaccatggacaaagcatcaagactcaaactgactccatctcccttgaggatgtggctgtgaacttcaccctggaggagtgggctttgctggatcctggccagaggaatatctacagagatgtgatgcgggcaaccttcaagaacctggcctgtataggggaaaaatggaaagaccaggatattgaagatgaacacaaaaaccagggaagaaatctaagaagtcctatggttgaagcactctgtgaaaataaagaagattgtccatgtggaaaaagcactagccagattcctgatcttaatacgaacctggaaactcctactggattaaaaccatgtgactgcagtgtgtgtggggaagtcttcatgcatcaggtctcccttaataggcacatgagatctcacactgaacagaaaccaaatgagtgtcacgaatatggagagaagccacataaatgcaaagaatgtgggaaaaccttcactcgcagctccagtattcgaacccatgaaagaattcacactggagagaaaccctatgaatgtaaggaatgtggcaaagccttcgcatttctcttttcctttcgaaaccatataagaattcatactggagagacaccctatgaatgtaaggaatgtggg

SEQ ID NO: 202688 - DNA, 553 bp, Homo sapiens
  Payload ID: 19973
  Gene Name: zinc finger protein 490
  ENST ID: ENST00000440366
  CDS Start-End: 161-553
agctctgaatgcgcgtgtgaacatccttattctagcggttcgctaggattgcgtcccagcctcggactgtctgtggctctgcgtatgctttgtctcactgggacctgcaggtagtgagggatccgtagggaggactcctggagcctccgtaagccgagaaatggactccatctcccttgaggatgtggctgtgaacttcaccctggaggagtgggctttgctggatcctggccagaggaatatctacagagatgtgatgcgggcaaccttcaagaacctggcctgtataggggaaaaatggaaagaccaggatattgaagatgaacacaaaaaccagggaagaaatctaagaagtcctatggttgaagcactctgtgaaaataaagaagattgtccatgtggaaaaagcactagccagattcctgatcttaatacgaacctggaaactcctactggattaaaaccatgtgactgcagtgtgtgtggggaagtcttcatgcatcaggtctcccttaataggcacatgagatctcacactgaacagaaaccaaat

SEQ ID NO: 202689 - DNA, 2471 bp, Homo sapiens
  Payload ID: 19974
  Gene Name: zinc finger protein 491
  Uniprot ID: Q8N8L2
  ENST ID: ENST00000323169
  CDS Start-End: 332-1645
aatccggggaagcagaaggccgcactcagagtctctgcactcctttgttgctggggtccgttgcgttctgcatccagtccttgctgctccgagaggccccaggtgcctccgccacggctcctgtgacgctgtcacctgcgctgtgacctgctccggagtcataaagaggacgccgggacaccaagaagcagggaaatggacccagtggcctttgaggatgtggctgtgaacttcacccaggaggagtgggccttgttgaatcctttccagaagatctctacagagatgtgatgcaggaaaccttcacgaacctcatctgtatagaaattttatgggagagagactctttgagagtgcagaaggtagtcagtgtggagaaactttcacccaggttccggaagacatgctgaacaagaaaactcttcctggagtaaaatcatgtgaaagtggtacatgtggagaaatcttcatgggatattcatcctttaataggaacatcagaactgacactggacaccaaccacataagtgtcagaaatttttagagaagccatataaacataaacaacgtaggaaagccttgagccatagccactgctttcgaacacatgaaaggcctcacactagagagaaaccttttgattgtaaggaatgtgaaaaatctttcatttctcctgcaagcattcgaagatatatggtaacgcacagtggagatggaccttataaatgtaagttttgtgggaaagccttggattgtctcagtttataccttacccatgaacgaactcacactggagagaaacgatatgaatgtaaacaatgtggtaaagccttcagttggcacagttctgttcgaatccatgaaagaactcacactggggagaagccatatgaatgtaaggagtgtgggaaatcattcaatttttccagttcctttcgcagacatgaaaggacacacacaggagagaagccgtacaaatgtaaggaatgtgggaaagccttcaattgtcccagttcttttcacaggcatgaaaggactcacacaggagaaaaaccctatgaatgtaaactatatgggaaagcattatctcgccttataagctttcgaagacacatgagaatgcacactggagagaggcctcataaatgtaagatatgtgggaaagccttttactctcccagttcatttcaaaggcatgaaagaagtcacactggagagaaaccctacaaatgcaagcaatgtgggaaagccttcacttgttccacttcgtttcaatatcatgaaaggactcacactggagagaaacccgatgggtgtaagcaatgtgggaaagccttcagatctgccaagtacattcgaatacatggaaggactcacactggtgagaaaccctatgaatgtaagcaatgtgggaaagcatttcattgtgtcagctcctttcatagacatgaaaggactcacgctggagaaaaaccttatgaatgtaagcattgtgggaaagccttcacttgttccatatatattagaatacatgaaagaattcacactggagagaaaccttaccaatgtaaggaatgtgggaaagccttcattcgttccagttactgtcgaaaacatgaaagaactcacactattaatatatgagagaaatgctattttttaatttttattttaatagagacagggtctcactatcttgtccaggttggtcttgaactcctggcctcaagcatccctcccagcttgaagtgtcaataaaggaaggcaataaaatgtagagatggagttaggtgatgccacgctgggattcactggtggcctatcttacatatgatttcgaaggcagacatgaggaaggccttagtcacattttagagccagccaaattcacatgggctgtgtggccccctgattctagcccattttcctgattctctggcttgtcaatcaagagtatcctccaaatctcttgactttccttttttcagaggtgtaggtttccaaagatgtccccagaagctccacattcaagttctatctacagtttggtttttctttaagtattgtaatgtacataccagagagataatgcagactgtcatgggtggggaatgttctctgatgctcaactcccctagtctgcagattgagttggtaggaggtgtgatttgtttacatgcacctttgttcctgctggtagtgaccttgttcttgattcagcctgacagctactatgctgccatcagaaccaacttgatgagagctctgctgccctgtgcagtgactggtctcatccaggactctcatgtgagaaggaacaccttgctctggtcaggaaatgtccagtgtttcctgttatccacaggagaatgtaatgcctcagttcattttcagttatctttgattatatgtgattgacaatgtgtatttttgagggagcaaagatttctgtacatatttcttaaaaata

SEQ ID NO: 202690 - DNA, 578 bp, Homo sapiens
  Payload ID: 19974
  Gene Name: zinc finger protein 491
  ENST ID: ENST00000450087
  CDS Start-End: 160-578
gttgctggggtccgttgcgttctgcatccagtccttgctgctccgagaggccccaggtgcctccgccacggctcctgtgacgctgtcacctgcgctgtgacctgctccggagtcataaagaggacgccgggacaccaagaagcagggaaatgaaattttatgggagagagactctttgagagtgcagaaggtagtcagtgtggagaaactttcacccaggttccggaagacatgctgaacaagaaaactcttcctggagtaaaatcatgtgaaagtggtacatgtggagaaatcttcatgggatattcatcctttaataggaacatcagaactgacactggacaccaaccacataagtgtcagaaatttttagagaagccatataaacataaacaacgtaggaaagccttgagccatagccactgctttcgaacacatgaaaggcctcacactagagagaaaccttttgattgtaaggaatgtgaaaaatctttcatttctcctgcaagcattcgaagatatatggtaacgcacagtggagatggaccttataaatgtaagttttgtgggaaagcctt

SEQ ID NO: 202691 - DNA, 4245 bp, Homo sapiens
  Payload ID: 19975
  Gene Name: zinc finger protein 492
  Uniprot ID: Q9P255
  ENST ID: ENST00000456783
  CDS Start-End: 245-1840
gtctttgtctctcgctgcagtcggagtatggtctagtgttcgctgttctgcgtcctctggtcctagaggcccatcctctgtggccctgtgacctgcaggtattgggagatccacagctaagacgctaggaccccctggaagcctagaaacgggagtgttgacatttagggatgtggccatagaattctctctggaggagtggcaatgcctggacaccgcacagcagaatttatataggaatgtgatgttagagaactacagaaacctggtcttcgtgggtattgctgcctctaagccagacctgatcacctgtctggagcaaggaaaagaaccttggaatgtgaagagacatgagatggtagctgaacccccagttgtatgttcttattttgcccgagacctttggccaaagcagggcaaaaaaaattatttccaaaaagtgatactgagaagatataaaaaatgtggatgtgaaaatttacagttaagaaaatactgtaaaagcatggatgagtgtaaggtgcacaaagaatgttacaatggacttaaccagtgtttgacgactacccagaacaaaatatttcaatgtgacaaatatgtgaaagtctttcataaattttcaaattcaaacagacatacgataagacatactggaaagaaatctttcaaatgtaaagaatgtgaaaagtcattttgcatgctttcacacttagctcaacataaaagaattcatagtggagagaaaccctacaaatgtaaagaatgtgggaaagcctataatgagacctcaaacctttctacacataaaagaattcatactggaaagaaaccctacaaatgcgaagagtgtggaaaagcctttaaccggctctcacaccttactacacataagataattcatactggaaagaaaccctacaaatgtgaggagtgtggcaaagcttttaaccaatctgcaaaccttactacacataagagaattcatactggagagaaaccctacaaatgtgaagaatgtggcagagcttttagccagtcctcaacccttactgcacataagataattcatgctggagagaaaccttacaaatgtgaagaatgtggcaaagcttttagccagtcctcaacccttactacacataagataattcatactggagagaaattctacaaatgtgaagaatgtggtaaggcctttagccagttatcccaccttactacacataagagaattcattctggagagaaaccctacaagtgtgaagaatgtggcaaagcttttaaacaatcctcaacccttactacacataagagaattcatgctggagagaaattctacaaatgtgaagtatgtagcaaagcctttagccggttctcacaccttactacacataagagaattcatactggagagaagccctacaaatgtgaagaatgtggcaaagcttttaacctatcgtcacaacttactacacataagataattcatactggagagaaaccctacaaatgtgaagaatgtggcaaagcttttaaccagtcctcaactctttctaaacataaggtaattcatactggagagaagccctacaaatatgaagaatgtggcaaagcttttaaccagtcctcacaccttactacacataagatgattcatactggagagaaaccctacaagtgtgaagaatgtggcaaagcctttaacaactcctctattcttaacagacataagatgattcatactggagagaaactctacaaacctgaaagttgtaacaatgcttgtgacaacattgcaaagatttccaaatataaaagaaattgtgctggtgagaaataatagaaatatgaatgtgacaaagcctttaaatggttatcacactggattgtaggtaaggtaattcattctggagaaaacttctacaagtgtgaatgaacagtgtggcaaaacttacacaatgctcaaaccttattgcacaggaaagcctttatacttgagaacaaatgtacaaatataaagaaagtaaaaaagtgattaatatctgtgcacatcttattcaacatcagagtttatattaatagcattaaaagtgcaattactgtcaaaagagttcaaaaaataagcatttaaagtgctgaagaggatttattttgaagacaaacattacaaatataaacgaagttgtggtaactttacttgtaacacagatcttgttgtattcattctgtattagagcaaaccctgaggcaattgctcaaactttgttcaacatcagagaatttatatcgaagaaaaaccctgtaaatgtaataaatttagaaaaaaacatttattcaaaaactacaggttagaaaattccagagagttcatattaaaatatttttgcatatacagtaaatagaaaaaaatatttaattcaatggtaagtttatgtaaatatcagagaatttatgttagaaatatataaggcaatgacacttcagactttacactgaatcagagttctgagtttagaaagtaatccaaaactaaacttggcagaaaaattatttgtttataactttaaaagagtagaagattttttggagagttacaagtatacttttttttagaaagattacagattttttttaaaagtaaataactctcaaattacttcatacaaataatgttgtaattaactcaaattacttcgtgttaatgttgtaattaactctcaaattacttcatgctaaggaaattagtttttctttttcttcttctttttttttttttttttagatggagtcttgctctatcgcccccccaggctggagtacagtggcacgatctcagctcactgcaacctccgtctccagggttcaagtgattctcctgcctcagcctcccaagtggctgggattacaggcgcaaaccaccatgcgtggctaaattttgtatttttaatagagccagggttttgccatgttggccaggctggtctcgaactcgagactttaggtgatccgcccagcttggcctcccgcaatgctgcaattacaggtgttagccactgcgcctgcctgatgttgtttctttattcctattgtattcatatgtgaaagcatgtgaccaaaagatatgaggattattttttattaggtgagcatttatgacctcttctatgaaagagtaaggacattaaaatgcatgatgaaaatctaagtaaagaggttctttgtgattcacttacagtactgagtgatgcatgaggtaggtgttctgagtaatattctgcattatattgagagacaaatttttagttttagttaaaattaaaaataaattagtatattattttactaattttacttttatgaaaatgcagtacatgttaaaaattttagattatgtgtgaacttaatttcttaattcaacatttttaacagtttaaatattgtgcattcaatcaagtcacattattccacttactttaacctagtccaccttactcaagggtgtaggtaaaaggtggtaacaaggccgggcacggtggctcacgcctgtaatcccagcactttgggaggcaaaggtgggtagatcacctgaggtcgggagttcaagaccagcctgaccaacatggagaaacgccatctctactaaaaatacaaaattagccaggcatggtggcgcatgcctgtaatcccagctactcgggaggctgaggcaggagaatcacttgaacccgggaagcagaggttgcggtgagccgagatcatgccatggcactccgtcctgggtgacaaagtgagactccctctcaaaaaataaataagtaaataaaataaatggtggtaacaatacactatttggtaaaagaatgcactaacatctgtagtactaatcttttttccagtggctttaaactgcaaataaggaatgttgtttctgtaggtaaaatttttatttattttttcccatttaaatttacttttgttagttttttcaggcatataatatttatgttatatatggcatattctgataagaggcatacaatatgtaataatcacattagggtaaatgaggtatccatcacctttagaatttattttttgtattatgaacagttcaattgtacagttttagtttttttaaaatatacgattgttattgactacagggttatttttataataaaaattatatacaagtataaaatttacacatttctgagtcctgaataaataaaaataatttcttgt

SEQ ID NO: 202692 - DNA, 1665 bp, Homo sapiens
  Payload ID: 19976
  Gene Name: zinc finger protein 493
  Uniprot ID: Q6ZR52
  ENST ID: ENST00000339914
  CDS Start-End: 83-394
ctccaggtctacccttcactgctctgtgtcctcagcgtgtgtggcttcgtgacctgaagatactgggaaatccatagctaagatgccaggaccccctgaaagcctagacatggggccgttgacatttagggatgtggccatagaattctctctggaggagtggcaatgcctggacactgctcagcaggatttgtataggaaagtgatgttagagaactacagaaacctggtcttcttggcaggtattgctgtctctaagccagatctggtcacctgtctggagcaaggaaaagatccctggaatatgaagggacacagtacggtagtcaaacccccagtagagacggggtttcaccgttttagccaggatggtctctatctcctgacctcgtgatccgcccgcctcagtctcccaaagtgctggtattacaggcgtgagccaccatgcccagcctaataaaaatttttttatttctattgtatccaatagcttgttttaagtgtgtagaacaataacttacacttttatgttaattttatattttgttaatttactgactgtattattagtttagacaaatttcaatgtactgtggttttttatgtgtaagattatatgttcctcaaacagcaactttttacttatttgtcttcagtttcaatggctttaaaaagaattcttttttcattattctgccacatgcttccagtgctatgttaaaatagaaacattgacaaagggcacaatagagtttactattggtgtctgtgaatttgaaatggcaaacaactccttaagtttttataagctgatttcaggaggtaaagatcttcttttcttgtgttccccagggttttgggatgccctctgggtttgtagtggagtggggttgtaacttggttgcaaggctgctggttctacattagggtccatatttagttgtcatgttacaagaggcttgggtagttgtacttcccaatttttttttttttttttttttttttttttgagacaggagtctcgctctgtcgcctggctggagtgcagtggtgtgatctcagctcatcaaaacttttgcctccctagttcaagcgattctcctacctcagcctcctgagtagctgggattacaggtgcccaccagcacgcccagctaattttttgtgtgtttttagtggagacggggtttcaccatgttggctaagctgggtctcgaactcctgacctcaggtgatccacccgccttggcctcctgggtgctgggattacagacgtgagccaccacccccggccacttgtttcttttaaatgcttattaaaagtttctcatcagaatattttatttataattatactgcatattctctgaaattttactgccaatttttcaaaatacctgcttttgatgagtacagttacagtcaaatactgtagttagacaaattcttttttaatggtatattaatgttgcataccaaattgtatgagttaaacgtctcttcctgtgcagtttcatattagtggtgttttcagtgtaggtatcttaatatcagcttatcgtggtttttggttatgtattataattttagtcaatttgcaattctgtctgtatactttatgtcaatgtgaggttgaattaaaagatagccatatgtctatcacaa

SEQ ID NO: 202693 - DNA, 4386 bp, Homo sapiens
  Payload ID: 19976
  Gene Name: zinc finger protein 493
  Uniprot ID: Q6ZR52
  ENST ID: ENST00000355504
  CDS Start-End: 267-2207
attgtttctctctgctgccggagctccaggtctacccttcactgctctgtgtcctcagcgtgtgtggcttcgtgacctgaagatactgggaaatccatagctaagatgccaggaccccctgaaagcctagacatgttatatgttctcattttgctgaagacttttgcccagggccaggcattaaagattcttttcaaaaagtgatactgagagaatatgtaaaatgtggacataaggatttacagttaagaaaaggatgtaaaagtatgaatgagtgtaatgtgcacaaagaaggttataatgaactaaaccagtatttgacaactacccagagcaaaatatttcaatgtgataaatatgtgaaagtctttcataaacttttaaattcaaatagacataacacaaaacatactggaaagaaacctttcaaatgtaaaaaatgtggcaaatcattttgcatgcttttacacctatgtcagcataaaagaattcatattagagagaattcttaccgatgtgaagaatgtggcaaagcctttatctggttttcaacccttactagacacaggagagttcatactggagagaaatcctacaaatatgaatgtggcaaatcttttaaccaggactcaaaccttactacacataagagaattcatactggacagaaaccctacaaatgtgaagaatgtggcacatctttctaccaattctcataccttactaggcataagctaattcatactagagagaaaccctataaatgtgaacaatatggcaaaacttttaaccaatcttcaacccttactggacataagataattcataatggagaaaaaccctataaatgtgaagaatgtggcaaagcctttagtattttctcaacccctactaaacataagataattcacactgaagagaaatcccacagatgtgaagaatattgcaaagcttataaggagtcctcacaccttactacacataaaagaattcatactggagagaaaccctacaaatgtgaagaatgtggcaaagcctttagtattttctcaacccttactaaacataagataattcacactgaagagaaatcccacagatgtgaagaatgtggcaaagcttataaggagtcttcacaccttactacacataaaagaattcatactggagagaaaccctacaaatgtgaagaatgtggcaaaacctttagtgtattctcaattcttactaaacataaaataattcatacagaagagaaaccctacaaatgtgaagaatgtggcaaagcttttaaacgatcttcaacccttactaaacataggataattcatactgaagagaaaccctacaaatgtgaagaatgtggcaaagcttttaaccaatcttcaacccttagtatacataaaataattcatactggagaaaaaccctacaaatgtgaagaatgtggcaaagcttttaaacgatcttcaacccttactatacataaaatgattcacactggagaaaaaccctacaaatgtgaagaatgtggcaaagcttttaatcggtcctcacaccttactacacataagagaattcatactggacacaaaccctacaaatgtaaagaatgtggcaaatcctttagtgtattctcaacccttactaaacacaagataattcatactgataagaaaccctacaaatgtgaagaatgtggcaaagcttttaaccgatcttcaatccttagtatacataagaaaattcatactggagaaaaaccctacaaatgtgaagaatgtggcaaagcttttaagcggtcctcacacctcgctgggcacaagcaaattcatagtgtacaaaaaccctacaaatgtgaagaatgtggcaaagcctttagtatattctcaacccttactaaacataagataattcatactgaagagaaaccctacaaatgtgaaaaatgtggcaaaactttctaccgattctcaaaccttaatacgcataagataattcatactggagagaaaccttgcaaatgtgaagaatgtggcaaagcttttaaccattcctcaaaccttattaaacataagctaattcatactggagacaaaccctacaaatgtgaagcatgtggcaaagcttttaggcggtcttcacatcttagtagacataagataattcatattggaattcatactgaagagactgtacaaaagtgaagaatgtggcaaaggcctttactgctcctattcccttactaaagaatgtggcaaagcttttcaccagtactttacccttaatacacataagataattaatgctggagagaaaccctacaaatgtgaagaatgtggcaaagatttctattgattctcataccttactaaatataagataattcatattggagagaaattctacagatgtgaagaatgtggcaaaggctttaattagttctcatcccttactaaacataagagaattcataccatagagaaatcctacaaatatgaagaatgtgacaaagcttttaaccacttctcaaccctgcctacacgtaagataattcatactggaaggaaaccctacaaatatgaggaatgtctcaaagctttttactgattcttataccttactaaacataaaataattcataaaggagataaattatacaaatgtgaagaatgtggcaaagcttttaacaaatcctcatccattagtaaacataagataattcatactggagagaaaacctacaaatgtgaggaatgtggcaaagcctttagcctgtccctccaatttactgcacataagataatttatactggagagaagccctacaaatgtgaaaaatgtggcaaaccttttaaccaatcctcaacccttactacacattagataattcatgctggagagaaaccctacaaatgtgaaaaatgtggcaaagcttttaaccaattttcaaaccttactaaacataagataactcatactggagaaaaatcttacaaatgtgaagaatgtggcaaagcctttatccagtcctcaactcctagtaaacataattaatgatggagagaaaccatacaactgtgaagaatgtggcaaagcttttaaccagtcctcaaactttattgaacaaaataattcatacaggagagaaaccctacaaatgtgaagaatgtgacaaagcctttaaccagtcctcaatttttactaaacataagaaaattcatactggagagaaaccctatgattgtgaaaaatatggcaaaggctttaactagtcctcagttcttaacacacatacgataattcttactgcagagaaactctacaaaccagtaagatgtgacagtgcttctgacaacatctcaaacttttctaatcataaaagaaatcatattggtgagaaatcctagaaatgtggagaatgtaacaaagtatttaaatggttgtcacacttgattataggtaatattcatattggaaaaatttcctacaagtaagaacaatgtggcaaagtttttaactaatacaccttattgcacagaaaatcatttatatttgagaaaaattgtagaaatatagactgtgaaaaagacgtcaatatctgctcacatcttactaaacaccagagagttcatgcttaataaaagcatgataagtgcaattactgccaaaagatctttcagaaaatattatcctttaaagtgaaggagagtatttatattaaagatgaacattacaaccataaagagggttgaagtacctttacttgtatcagatcttattgtccacattttgtactacagaaaaactctgaagaggtcactcaaactttgttcaacatcagggaatttatattggagagctgtcttgcaaatgtaataaatttgggaaaacaaattttcaaaaactacagcttagaaaacaccagagtttatacgaaaatatattttcaaaggtgtagtaaaaataaaaaaaattttaatccaaatttgtctatgtaaataccagaatttatagtagaaatatatgaggaagcgacacttcgaatattctactaaatgagagttctgagtatagaaaataaaactaaagttggtagaaaaattatttgtatataatgttaagaggagtaaaagattttttgtagaataataactatattcggattatactttgtttcttgaaaaaattacagattttttgaaaagcaaatgatgtaactcaactcattattttctgctgtttcttcattcttattcacttgtgaaagcttgtgatcatttgttgctgcatcagaggtatgagagattcttcttcattagatgggcattatttatgatcttttctatggatgagtaagaatattaaaatgtaagatgcatggtg

SEQ ID NO: 202694 - DNA, 5023 bp, Homo sapiens
  Payload ID: 19976
  Gene Name: zinc finger protein 493
  Uniprot ID: Q6ZR52
  ENST ID: ENST00000392288
  CDS Start-End: 110-2434
ggccattgtttctctctgctgccggagctccaggtctacccttcactgctctgtgtcctcagcgtgtgtggcttcgtgacctgaagatactgggaaatccatagctaagatgccaggaccccctgaaagcctagacatggggccgttgacatttagggatgtggccatagaattctctctggaggagtggcaatgcctggacactgctcagcaggatttgtataggaaagtgatgttagagaactacagaaacctggtcttcttgggtattgctgtctctaagccagatctggtcacctgtctggagcaaggaaaagatccctggaatatgaagggacacagtacggtagtcaaacccccagttatatgttctcattttgctgaagacttttgcccagggccaggcattaaagattcttttcaaaaagtgatactgagagaatatgtaaaatgtggacataaggatttacagttaagaaaaggatgtaaaagtatgaatgagtgtaatgtgcacaaagaaggttataatgaactaaaccagtatttgacaactacccagagcaaaatatttcaatgtgataaatatgtgaaagtctttcataaacttttaaattcaaatagacataacacaaaacatactggaaagaaacctttcaaatgtaaaaaatgtggcaaatcattttgcatgcttttacacctatgtcagcataaaagaattcatattagagagaattcttaccgatgtgaagaatgtggcaaagcctttatctggttttcaacccttactagacacaggagagttcatactggagagaaatcctacaaatatgaatgtggcaaatcttttaaccaggactcaaaccttactacacataagagaattcatactggacagaaaccctacaaatgtgaagaatgtggcacatctttctaccaattctcataccttactaggcataagctaattcatactagagagaaaccctataaatgtgaacaatatggcaaaacttttaaccaatcttcaacccttactggacataagataattcataatggagaaaaaccctataaatgtgaagaatgtggcaaagcctttagtattttctcaacccctactaaacataagataattcacactgaagagaaatcccacagatgtgaagaatattgcaaagcttataaggagtcctcacaccttactacacataaaagaattcatactggagagaaaccctacaaatgtgaagaatgtggcaaagcctttagtattttctcaacccttactaaacataagataattcacactgaagagaaatcccacagatgtgaagaatgtggcaaagcttataaggagtcttcacaccttactacacataaaagaattcatactggagagaaaccctacaaatgtgaagaatgtggcaaaacctttagtgtattctcaattcttactaaacataaaataattcatacagaagagaaaccctacaaatgtgaagaatgtggcaaagcttttaaacgatcttcaacccttactaaacataggataattcatactgaagagaaaccctacaaatgtgaagaatgtggcaaagcttttaaccaatcttcaacccttagtatacataaaataattcatactggagaaaaaccctacaaatgtgaagaatgtggcaaagcttttaaacgatcttcaacccttactatacataaaatgattcacactggagaaaaaccctacaaatgtgaagaatgtggcaaagcttttaatcggtcctcacaccttactacacataagagaattcatactggacacaaaccctacaaatgtaaagaatgtggcaaatcctttagtgtattctcaacccttactaaacacaagataattcatactgataagaaaccctacaaatgtgaagaatgtggcaaagcttttaaccgatcttcaatccttagtatacataagaaaattcatactggagaaaaaccctacaaatgtgaagaatgtggcaaagcttttaagcggtcctcacacctcgctgggcacaagcaaattcatagtgtacaaaaaccctacaaatgtgaagaatgtggcaaagcctttagtatattctcaacccttactaaacataagataattcatactgaagagaaaccctacaaatgtgaaaaatgtggcaaaactttctaccgattctcaaaccttaatacgcataagataattcatactggagagaaaccttgcaaatgtgaagaatgtggcaaagcttttaaccattcctcaaaccttattaaacataagctaattcatactggagacaaaccctacaaatgtgaagcatgtggcaaagcttttaggcggtcttcacatcttagtagacataagataattcatattggaattcatactgaagagactgtacaaaagtgaagaatgtggcaaaggcctttactgctcctattcccttactaaagaatgtggcaaagcttttcaccagtactttacccttaatacacataagataattaatgctggagagaaaccctacaaatgtgaagaatgtggcaaagatttctattgattctcataccttactaaatataagataattcatattggagagaaattctacagatgtgaagaatgtggcaaaggctttaattagttctcatcccttactaaacataagagaattcataccatagagaaatcctacaaatatgaagaatgtgacaaagcttttaaccacttctcaaccctgcctacacgtaagataattcatactggaaggaaaccctacaaatatgaggaatgtctcaaagctttttactgattcttataccttactaaacataaaataattcataaaggagataaattatacaaatgtgaagaatgtggcaaagcttttaacaaatcctcatccattagtaaacataagataattcatactggagagaaaacctacaaatgtgaggaatgtggcaaagcctttagcctgtccctccaatttactgcacataagataatttatactggagagaagccctacaaatgtgaaaaatgtggcaaaccttttaaccaatcctcaacccttactacacattagataattcatgctggagagaaaccctacaaatgtgaaaaatgtggcaaagcttttaaccaattttcaaaccttactaaacataagataactcatactggagaaaaatcttacaaatgtgaagaatgtggcaaagcctttatccagtcctcaactcctagtaaacataattaatgatggagagaaaccatacaactgtgaagaatgtggcaaagcttttaaccagtcctcaaactttattgaacaaaataattcatacaggagagaaaccctacaaatgtgaagaatgtgacaaagcctttaaccagtcctcaatttttactaaacataagaaaattcatactggagagaaaccctatgattgtgaaaaatatggcaaaggctttaactagtcctcagttcttaacacacatacgataattcttactgcagagaaactctacaaaccagtaagatgtgacagtgcttctgacaacatctcaaacttttctaatcataaaagaaatcatattggtgagaaatcctagaaatgtggagaatgtaacaaagtatttaaatggttgtcacacttgattataggtaatattcatattggaaaaatttcctacaagtaagaacaatgtggcaaagtttttaactaatacaccttattgcacagaaaatcatttatatttgagaaaaattgtagaaatatagactgtgaaaaagacgtcaatatctgctcacatcttactaaacaccagagagttcatgcttaataaaagcatgataagtgcaattactgccaaaagatctttcagaaaatattatcctttaaagtgaaggagagtatttatattaaagatgaacattacaaccataaagagggttgaagtacctttacttgtatcagatcttattgtccacattttgtactacagaaaaactctgaagaggtcactcaaactttgttcaacatcagggaatttatattggagagctgtcttgcaaatgtaataaatttgggaaaacaaattttcaaaaactacagcttagaaaacaccagagtttatacgaaaatatattttcaaaggtgtagtaaaaataaaaaaaattttaatccaaatttgtctatgtaaataccagaatttatagtagaaatatatgaggaagcgacacttcgaatattctactaaatgagagttctgagtatagaaaataaaactaaagttggtagaaaaattatttgtatataatgttaagaggagtaaaagattttttgtagaataataactatattcggattatactttgtttcttgaaaaaattacagattttttgaaaagcaaatgatgtaactcaactcattattttctgctgtttcttcattcttattcacttgtgaaagcttgtgatcatttgttgctgcatcagaggtatgagagattcttcttcattagatgggcattatttatgatcttttctatggatgagtaagaatattaaaatgtaagatgcatggtgaaaatctaagtggagaggttctttgtggttaacttatactattgagtgatgcacaaggtaggtgttaagagtaatattcttttgcattatgagaaaactagtatattattcatatattttactaattgtactttttttattatactttaagttttagggtacatgtgcacaatgtgcaggttagttacatatgtatacatgtgccatgctggtgcgctgcacccactaactcgtcatctagcattaggtatatctcccaatgctatccgtcccccctccccccaattgtacttttatataataaaatgcagtacattttaaaaaattttaaattctgtgtgaaggtaactgtttcaacatttttaacatggtaaatattattgtgcattcaataaagtgttgttatgcca

SEQ ID NO: 202695 - DNA, 496 bp, Homo sapiens
  Payload ID: 19976
  Gene Name: zinc finger protein 493
  ENST ID: ENST00000596815
  CDS Start-End: 106-252
attgtttctctctgctgccggagctccaggtctacccttcactgctctgtgtcctcagcgtgtgtggcttcgtgacctgaagatactgggaaatccatagctaagatgccaggaccccctgaaagcctagacatggtgagagtgctgggtccgacatcacgagagaggggaaggagttgctcggaaccggtgggaagtggctgtggcgggactcaggcctccccgcagtcagctccacaatctgctccctgagttctccttgcccagctcggcctcagtctccttcagccgggccgttgacatttagggatgtggccatagaattctctctggaggagtggcaatgcctggacactgctcagcaggatttgtataggaaagtgatgttagagaactacagaaacctggtcttcttggcaggtattgctgtctctaagccagatctggtcacctgtctggagcaaggaaaagatccctggaatatgaagggacacag

SEQ ID NO: 202696 - DNA, 546 bp, Homo sapiens
  Payload ID: 19976
  Gene Name: zinc finger protein 493
  ENST ID: ENST00000596302
  CDS Start-End: 120-407
gatgtggctgggccattgtttctctctgctgccggagctccaggtctacccttcactgctctgtgtcctcagcgtgtgtggcttcgtgacctgaagatactgggaaatccatagctaagatgccaggaccccctgaaagcctagacatggggccgttgacatttagggatgtggccatagaattctctctggaggagtggcaatgcctggacactgctcagcaggatttgtataggaaagtgatgttagagaactacagaaacctggtcttcttggcaggtattgctgtctctaagccagatctggtcacctgtctggagcaaggaaaagatccctggaatatgaagggacacagtacggtagtcaaacccccaggttttcttccgccatctgtgacagcttcttgatctgtcccaagttatatgttctcattttgctgaagacttttgcccagggccaggcattaaagattcttttcaaaaagtgatactgagagaatatgtaaaatgtggacataaggatttacagttaagaaaaggatgtaaa

SEQ ID NO: 202697 - DNA, 1536 bp, Homo sapiens
  Payload ID: 19976
  Gene Name: zinc finger protein 493
  ENST ID: ENST00000594390
  CDS Start-End: 106-390
attgtttctctctgctgccggagctccaggtctacccttcactgctctgtgtcctcagcgtgtgtggcttcgtgacctgaagatactgggaaatccatagctaagatgccaggaccccctgaaagcctagacatggggccgttgacatttagggatgtggccatagaattctctctggaggagtggcaatgcctggacactgctcagcaggatttgtataggaaagtgatgttagagaactacagaaacctggtcttcttgggtattgctgtctctaagccagatctggtcacctgtctggagcaaggaaaagatccctggaatatgaagggacacagtacggtagtcaaacccccaggttttcttccgccatctgtgacagcttcttgatctgtcccaaggtgggtggctgtgttcgacgtgtgttgcttgtgacgcttggggttgtcctcagcatcaatcttgacatggctgcaacgagggggtcctcgggatcctcccagaatctcttcctcagcatctggctcatgataaagtttcaggtatcttgatggtatccaaatcagctgttgattttggcctggaggaacacaagcataatctctaccccaagttattttacccatttgccaactttttgttattggatctctccaccaaatcagttgttctgcttctctctttgcagctggtttctgtacatgctgttcagctgctgataacatctggcctttgggcaggctcaaaaaatttaaagttaataatgctagattcaggagcatctgtggggttacatattgtctatttccccccgtctccttctgcaactgctgttttagggagagattcattctttccactatggcttgtccttgagaattgtatgggataccggtaatgtgtttaatattccacacagagaaaaatgtagctagagcttggctagtatagcctggggcattatctgttttaatagaagctggaatgcccaccaccacaaaacactgcaaaaggtgatgtttaactaacacaggcagaagactctcctgattggcatgtagcccagacaaagtaagaaaaggtgtccacacatacatgtatataagctagtctcccaaatgagggaacatgtgtgacatccatttgccaaatagagttaggttccaatcctcgaggattaacccctcctgtaaaagatgaggaatgtaccatttggcaagttgggcattgctggataatagctttagcttctttccaggtaatgctgtatctgcatttgagactagaggcattaacatgggttaaattgtgaaagtgtctagcattagatattgcgttagcaactaggcaatcggccatttgattcccttcagtcaaaggtcctggaagaggtgtatgagcgagccctaatgtgagtgatgtaaaaaggatgcattgtactcctaactgctatttgcaattgggtaaataaagtgatcagttgttcatctgtatgaaatcgtaactgagcattttcaataaactgtgtggaatgaa

SEQ ID NO: 202698 - DNA, 1769 bp, Homo sapiens
  Payload ID: 19976
  Gene Name: zinc finger protein 493
  ENST ID: ENST00000599461
  CDS Start-End: 73-219
acccttcactgctctgtgtcctcagcgtgtgtggcttcgtgacctgaagatactgggaaatccatagctaagatgccaggaccccctgaaagcctagacatggtgagagtgctgggtccgacatcacgagagaggggaaggagttgctcggaaccggtgggaagtggctgtggcgggactcaggcctccccgcagtcagctccacaatctgctccctgagttctccttgcccagctcggcctcagtctccttcagccgtaagttggcggctgcgccaacagccggggccccgggcgtcctgtctcttccctgcactgtgactgtgccctgcctggagtcctctctggcagttctgcacccgcagcgccgcgtctttctcagattgtgcggggaccacgggagggtcatcaggggagaatcctgacttggggtgcgggttcatgaatgggaagagctttggtccgtggggttcccagttgctattttctcctattaaaaatttatgggcgtcactgcaaaaatattaaagaatgtaatcaaagagtggttctagaattgtagagcacccagctatggtttgtagtttgtggtctgtgggagaggcttgaaggaaagtcttttataaaatgcatgatgaagaaaccaaatttactaattggttaggtacagttacatggtttcttaatatgtgcgttaaaggtgaaaatttcctggttatgtaatcagagcttaattggcagtttacagttgctgaagcctgaattttgtttctctgaatgtagtaattaaaaataatgcacctgagttagattttttttttaaagtaagaattcagggactagaaatacctcagtctaattgcctgccacttaattattttcacactccacagggaactgattttctgctgtatttttcacctgtgtcccaagcagagtcttggaaccaatcccccatttctccggcctcactctggcttgcagtaagataatttccagtttcctctgacgttcctaaatgccaccttttcctccctaattcacattatcgcctatttgtcttttactgtacttttttataccatattttaattatttttttggcaaagcattaaatggttaaatggtgcatttaaagagatttgttatctgtttgtaaatatttcccatgaaaagaaggcaaataataataccctgacactgcattgtagtaaatctctgtctcttttgctttcatcttgtctaggcacagagatgttaccagaatgtttttgggtcgaagttctcctttggaaaatctatggggtgatgtgtcctcagccaccctttggttttttcctggtcatgggtttcagtactatctggggataaaccaagataactgccatggttatgttagctagagtgtccattggatctcagcttctggtttattttctcccataagatgacctgaggtatggagtgtatcctctcaagggagcaagtggatattctggggctgaggggaatcttccggtgtactcttattttgaaacgggtaaccctttgaaatgttaaaattgccttccctcaaccaggcttccatttcttggagacaaattgctggtcagccaatcagatgctggtaatgaggggaaaacacagaaataatttctgccccctggattctctaagggggcagaaaaatagtgaaattaatatagtaaaagaaaaagagtaaaaaaaaaaaagtgaaaaatttgtggcccaaaaaatagtatcccaaaa

SEQ ID NO: 202699 - DNA, 5336 bp, Homo sapiens
  Payload ID: 19977
  Gene Name: zinc finger protein 496
  Uniprot ID: Q96IT1
  ENST ID: ENST00000294753
  CDS Start-End: 466-2229
ggcccgcgcccggcctccgcggcgccgcctcccagcccagagcccagcgctcaggaaggtgcgggcgggggagaaagcaacaccattgtttttcaggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagggtcgtcttctgctgctgacccccatcaaatcccatcatgcccacagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgatttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggcttttactttctaaatagtttgtctcttgtatcaacatagctggaaaagggagaaatccgatttttaaggccaagggaggggaaaattccaagtagaagccaggctctctgtacacgtttaccccacctacctgtgtgctcctacctgtgctgaggattctctctgtagctctaaggtcttgggaaggttattcaccttcctgcttcagacgtctgactcaagagaagaacactgttctacttaccagagtgtttttctgtgtaaaaccacatcatgaaggagaaagcgacaaagggaatgtgaggggctggaagccacagggaggctgtctcttgagtccccaccactgatccagagccaaccaaggcacctcaggaaatggaaggccacattgcctctggatttggaaatcctcctgggtaatgtaactgaaacccaggttgatgccatgcagcaggagcagcagggggaacgtgctctcaggagaggtcggccaaccctccagcccaacacccttcaccacagtggtggaggaggctgcacccaggagatctttgtctcccttttggccactgatacctttggccttatctgacaacagctacccctcgatccttccctcccaccccaggggctgggcagctggctggagctttgtgtccaccttgctctggaggttgagacccccatctgagcaacatcctctctctttgttcctctgatcccttggcatcgtcacaaacccacaggtgcataataaaaacttgctgagtcaatat

SEQ ID NO: 202700 - DNA, 3857 bp, Homo sapiens
  Payload ID: 19977
  Gene Name: zinc finger protein 496
  ENST ID: ENST00000461277
  CDS Start-End: 1-1539
caggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagaatttttcaatttaataatcatcgcagcaatggttatattttagaaatgttaggaagtggagggaagaaagcacagataatttcagtcctgtcacagatctacgtgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgatttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaa

SEQ ID NO: 202701 - DNA, 3468 bp, Homo sapiens
  Payload ID: 19978
  Gene Name: zinc finger protein 497
  Uniprot ID: Q6ZNH5
  ENST ID: ENST00000311044
  CDS Start-End: 190-1686
accattccacgcggctcgagcccgcgtgcgggcctctttcaggccgctcctagtggacgcagaggcgggccgaggacggtgccagcccccaggccccaagaggagctggtccccaggacagaggagggagaggagcaagaggctcccctgggccccttccaggccccacctccaggtcacaggcgcgagatggagtccccaagagggtggaccctgcaggtggccccagaggaaggccaggtcctctgcaatgtgaagactgccacgaggggcctctctgagggggctgtgtctggaggctggggggcctgggaaaactccacggaggttccgagggaggcaggggacggccagcggcagcaagccacactgggggcggcggacgaacagggaggccccggcagggagctgggccccgcagacggtgggcgggacggggctgggcccaggagcgagcctgcagaccgggcgttgcgcccttcgcctctcccagaggagccgggctgccggtgcggggagtgcggcaaggcgttcagccagggctcttacttgctgcagcatcggcgcgtgcacacaggcgagaagccgtacacgtgccccgagtgcggcaaggccttcgcctggagctccaacctcagccagcaccagcgcatccacagcggcgagaagccctacgcttgcagggagtgcggcaaggccttccgcgcgcactcgcagctcatccaccaccaggagacacacagcggcctgaagcccttccgctgcccggactgcggcaagtccttcggccgaagcaccacgctggtgcagcaccgacgcacgcacacgggcgagaagccctacgagtgcccggagtgcggcaaggccttcagctggaactccaatttcctggagcaccggcgcgtgcacacgggcgcgcggccgcacgcctgccgggactgtggcaaggccttcagccagagctccaacctggccgagcacctgaagatccacgcgggcgcacggccacacgcctgtcccgactgcggcaaggccttcgtgcgtgtggcggggctgcggcagcaccggcgcacgcacagcagcgagaagcccttcccctgcgccgagtgcggaaaggctttccgcgagagctcgcagctcctgcagcaccagcgcacgcacactggtgagcggcccttcgagtgcgccgagtgcggccaggctttcgtcatgggctcctacctggcggagcaccggcgcgtgcacacgggcgagaagcctcatgcgtgcgcccagtgcggcaaggccttcagccagcgctccaacctactgagccaccggcgcacgcactcgggcgccaagcccttcgcctgcgccgactgcggcaaggccttccgcggcagttccggcctggcgcaccaccggctttcgcacacgggagagcgacccttcgcctgcgcagaatgcggcaaggccttccgcggcagctccgagctgcgccagcaccagcgcctgcactctggcgagaggccgttcgtctgcgcccactgcagcaaggccttcgtgcgcaagtcggagctcttaagccaccggcgcacgcacacgggcgagaggccctacgcttgcggcgagtgcgggaagcctttcagccaccgttgcaacctcaacgagcaccagaagcggcacgggggccgcgctgcgccctgacccgaggacgccctgagcgggaggtcgcggacacacggcattgcggggtctcgggcgtgagtgcgctgtctgctggcccagactttttcgggccgccggtgcgggcgccctcctgctgggagtgcaggggcggccttgggtgtggagaaccctggctgcacagtccctttgacgatagtccaccggccacccaggcctgtctggggacatgtaggatgggctcttaccccagggagggcggcaggctccacttcggcgagaggttcgtccatgcagaggtgggcaagaactggggtctccgacaggtgtggctatttctttgagttctctggcactgtcaaaagcagccaacccaccccccagtccacatggtcaccactgctgctaccagctgctcagtgcagtggccactgtgtctcctaaggtgctcgcttcagtcagcacttcatctcaggcaaccacaggtgacagttaaacatgatgaaaccgcatgctatggctttctagtgtctcatattctgttggcaagaagctcagcactgcattcctgaccgaggtcagaaccagatcaatctcagaatctcacctgtgtaggtctgtttcatgggacttttcttttttgggggagggggcagggtttcactctgtcacccaggctggagtgcagtggtgcaatcactgtttattgcagccgcgacttcttaggctcaggtgatcctcccacctcagcctcccaagcagctgggatgacagacttgcgtcactacacctggctaattttaaaattttttgtaaggacagtgtctcaccatgttgcctaggcgggtctcaaaactcctgggctcaagtgatcctcctgcctcagcctcccaaagcgttgggattataggcgtgagccaccgcacctggccagggaaccttctttataccaagtaccacaccagtcagagtcaagtcaggaaatagaaaccacactaggtatttcaaacagaggggatataagttagggactgattgtgcaggttttgcaaggctcagagagcaaaagtggatgttgcagaatctcagagctggatacttgcaggaagctgctaccacccttagggctggagaacccagggaagctaagaggagggtgcaacgaggctggtgttgggactgccaaaggaaacacagaatgacagctccatctctgcagacctcagatttgaccaggcctctggctgcctgggcagcctcattgccaatgggctgaaaggttctgtcactgttcagtggtctgacttctgagttctgtgcacaccctgagctctgctcctctggcctggccaccagtccttgtctgagtgccccaggtctggttatgacttcaggcctcagcacctggttgtctcttctgcaaagaatgcattctcccccagtccacccagaacacacagcctccatccaggtactggctctgagcaggacagagagcatgcagcaggtgctcagcaatatggaaatgggaccaaacagagggagtctccacagctccccgtccctcacagcagaagccagagccgctgcagtgcccagctggtcttcatcacgtctatgagctctgcaatcgctctgcagtcgcctcaactcctggtctcctctgctccttctcactgcacccgcatctcccatgtttgcactggctgttccctctgcctggaatgctccttgcccagttatcccactgtcttctttgcatctggcacacagtagatgctcaataaatgcctgtggaatgaa

SEQ ID NO: 202702 - DNA, 2261 bp, Homo sapiens
  Payload ID: 19978
  Gene Name: zinc finger protein 497
  Uniprot ID: Q6ZNH5
  ENST ID: ENST00000425453
  CDS Start-End: 187-1683
atagttacgcaggcgcagtggggagaaacgcgacgccttgggccgctctgccgaatgcaaccgcgcccccaggagacccggtgcccgccctcctaccattccacgcggctcgagcccgcgtgcgggcctctttcaggccgctcctagtggacgcagaggcgggccgaggacggtcacaggcgcgagatggagtccccaagagggtggaccctgcaggtggccccagaggaaggccaggtcctctgcaatgtgaagactgccacgaggggcctctctgagggggctgtgtctggaggctggggggcctgggaaaactccacggaggttccgagggaggcaggggacggccagcggcagcaagccacactgggggcggcggacgaacagggaggccccggcagggagctgggccccgcagacggtgggcgggacggggctgggcccaggagcgagcctgcagaccgggcgttgcgcccttcgcctctcccagaggagccgggctgccggtgcggggagtgcggcaaggcgttcagccagggctcttacttgctgcagcatcggcgcgtgcacacaggcgagaagccgtacacgtgccccgagtgcggcaaggccttcgcctggagctccaacctcagccagcaccagcgcatccacagcggcgagaagccctacgcttgcagggagtgcggcaaggccttccgcgcgcactcgcagctcatccaccaccaggagacacacagcggcctgaagcccttccgctgcccggactgcggcaagtccttcggccgaagcaccacgctggtgcagcaccgacgcacgcacacgggcgagaagccctacgagtgcccggagtgcggcaaggccttcagctggaactccaatttcctggagcaccggcgcgtgcacacgggcgcgcggccgcacgcctgccgggactgtggcaaggccttcagccagagctccaacctggccgagcacctgaagatccacgcgggcgcacggccacacgcctgtcccgactgcggcaaggccttcgtgcgtgtggcggggctgcggcagcaccggcgcacgcacagcagcgagaagcccttcccctgcgccgagtgcggaaaggctttccgcgagagctcgcagctcctgcagcaccagcgcacgcacactggtgagcggcccttcgagtgcgccgagtgcggccaggctttcgtcatgggctcctacctggcggagcaccggcgcgtgcacacgggcgagaagcctcatgcgtgcgcccagtgcggcaaggccttcagccagcgctccaacctactgagccaccggcgcacgcactcgggcgccaagcccttcgcctgcgccgactgcggcaaggccttccgcggcagttccggcctggcgcaccaccggctttcgcacacgggagagcgacccttcgcctgcgcagaatgcggcaaggccttccgcggcagctccgagctgcgccagcaccagcgcctgcactctggcgagaggccgttcgtctgcgcccactgcagcaaggccttcgtgcgcaagtcggagctcttaagccaccggcgcacgcacacgggcgagaggccctacgcttgcggcgagtgcgggaagcctttcagccaccgttgcaacctcaacgagcaccagaagcggcacgggggccgcgctgcgccctgacccgaggacgccctgagcgggaggtcgcggacacacggcattgcggggtctcgggcgtgagtgcgctgtctgctggcccagactttttcgggccgccggtgcgggcgccctcctgctgggagtgcaggggcggccttgggtgtggagaaccctggctgcacagtccctttgacgatagtccaccggccacccaggcctgtctggggacatgtaggatgggctcttaccccagggagggcggcaggctccacttcggcgagaggttcgtccatgcagaggtgggcaagaactggggtctccgacaggtgtggctatttctttgagttctctggcactgtcaaaagcagccaacccaccccccagtccacatggtcaccactgctgctaccagctgctcagtgcagtggccactgtgtctcctaaggtgctcgcttcagtcagcacttcatctcaggcaaccacaggtgacagttaaacatgatgaaaccgcatgctatggctttctagtgtctcatattctgttggcaagaagctcagcactgcattcctgaccgaggtcagaaccagatcaatctcag

SEQ ID NO: 202703 - DNA, 792 bp, Homo sapiens
  Payload ID: 19978
  Gene Name: zinc finger protein 497
  ENST ID: ENST00000595763
  CDS Start-End: 467-792
agaaacgcgacgccttgggccgctctgccgaatgcaaccgcgcccccaggagacccggtgcccgccctcctaccattccacgcggctcgagcccgcgtgcgggcctctttcaggccgctcctagtggacgcagaggcgggccgaggacggtgccagcccccaggccccaagaggagctggtccccaggacagaggagggagaggagcaagaggctcccctgggccccttccaggccccacctccagggatctgggctgcacagccaccccatgccttggaccacctggtctgacctgcacagaggcctggtgtggacattgcctgggtaacagccactgagatcctccagcctggacatgctgcccatactgtgtggaggggactacccagggatccggccagggtggagtgggtgaggcagacatagctgtgtttgggtcaggcggtgtcctccagccttcaggaatggagacgggtccatcgtgttcctcacaaactggagtctccaccttcttgacacttggggccccaccctgtgaagcaaggagaggagagtggtgccacagtagggccagtgcaggtcacaggcgcgagatggagtccccaagagggtggaccctgcaggtggccccagaggaaggccaggtcctctgcaatgtgaagactgccacgaggggcctctctgagggggctgtgtctggaggctggggggcctgggaaaactccacggaggttccgagggaggcaggggacggccagcggcagcaagccacactgggggcggcggacga

SEQ ID NO: 202704 - DNA, 5880 bp, Homo sapiens
  Payload ID: 19979
  Gene Name: zinc finger protein 500
  Uniprot ID: O60304
  ENST ID: ENST00000219478
  CDS Start-End: 301-1743
ttagccaatggtgccacggctacgttacccacaatgccgcctgcgggcccacccgcacggcctggtttgcacccctggtttagggtcttcggccccggctctggcgtccctggctgccaagcctgaggcccgcagtcctactcccgccgagacccgccgctccggtcctgccccgaactgcccacggccggcagcgcttccaggccctgaaaaaaactctcttcctgtgtctggccagaggtatagagagagacaggttcaactctaaggcctgaaaaggaacaaggcccaccggaagcaatggccactgtccctggcctccagcccctgccaaccttggagcaggacctggaacaggaagagatcctgattgtgaaggtggaggaggacttctgcttggaagaggagccctccgtggagacggaggaccccagccctgagactttccgccagctcttccggctcttctgctaccaggaggtggctgggccccgggaggccctgagccgcctctgggagctgtgctgccgctggctgcggccggagctgcgcaccaaggagcagatcctggagctgctggtgctggagcagttcctgactgtgctgccgggggagatccaggctcgggtacgcgagcagcagccggagagcggtgaggaggccgtggtccttgtggaagggctgcagcggaagcccaggaaacacaggcagcggggctcagagctgctttctgatgacgaggtgcccctcgggatagggggacagttcttaaaacaccaggcagaggctcagccagaggatctgtccctggaggaagaggctcgattctccagccagcagcccccagcccagctgagccacaggccacagaggggcccgctgttgtggccagagagaggccctccagctccccggcatcaggagatggcgtcagcctcgcccttcctttcggcctggtcccaggtgcccgtgaacttggaggacgtggctgtatacctttctggggaggagccaagatgcatggacccagctcagcgggacgcgccgctggagaatgaaggacctgggatccagttggaggacggcggtgatggcagggaggatgccccgttgagaatggagtggtaccgagtgctctcggcacgatgccaggggcctggccacccgctcccaggtcagaggccagccccagtcaggggcttggtcaggcctgatcagccaagaggcggccccccaccaggaagacgggcttcccatggggctgacaagccgtacacctgccccgaatgtggcaaaggcttcagcaagacgtcccacttgaccaagcaccagcgcacacacacgggcgagcggccttacaagtgcctagtctgtgggaagggctttagcgaccgctccaacttcagcacgcaccagagggtgcacacaggcgagaagccctacccgtgccccgagtgtgggaagcgcttcagccagagctccagcctggtcatccaccgcaggacacacagcggggagcggccctatgcctgcacccagtgcgggaagcgcttcaacaacagctcgcacttcagcgcccaccgccggacgcacacaggtgagaagccctacacctgcccggcctgtggccggggcttccgccggggcaccgacctgcacaagcaccagcggacccacatgggggcaggctccttgccgacgctccagccggtggctcctggaggccccggtgccaaagcctgatcaccaggcctgaaactccctttccaggactctcatccctgggcacagaattcaggaaactgctagacagcctggtccgaaagcattgccagctgcccgtttcctcccatggcccagtatgaggccagcaggggacatttgggatgcccaggccgcagaggaagctgggcactgggtgcagaacaagggcaaggacaggctctgagtgtccagtggcagccagaacaggtgacacagagcaggggcttcagccacagagacacactcaggaggccagaagccgacactcaaggtgttcgtggggctggctcctgaagggcctgggagggtccatcagctgcctccagcatccagtggctgctggcatacagcctcatccccacgtcccaacccctctcctgtgtgtctgtgaccctgtgcgctgtctctgtgtgtaccccccacctgctcccccccccttttttttttgagacggggccttgctgtgtcccccaggcgggaatacagtgccatgatcatagctcactgcagcctcgaatccctgggctcaagtgttcctcctgcctcatcctcctgagtagctggggttacaggtgtgtgccgccatgcccagtctcttttttggtagggccaccactcactgggtttagggtcccccaatacactgtgacctcatcttaactaattatatcatcaaaacccgtgtttccaaataaggtcacattctgaggtctgggtgcacatgaatttgagggacccctcgtctgctgcagggagccctgctgtaccccagccttcccaggacgtggtctccagcttcttcatcctgccagagtttccaaatggagcccggggctctgcagcattccagtcccctttgcagatccatagctgctctgcagggcggaagacacctggggcgggaaagcacccctgagttccatcttcctgacatgttgcctgggatgtgacgggcctgacatctccccagggccggggcccagggctgcgtttgctcctggccccttagtgtctggaatgtggccttccacggttgccccactttgtctttctaaggtaagaagccttcaccttccagcttttgtctggcctgtgctgcgtgggagccactggtctgtgcacatccacggtgggtgagtggccaagacaagcagtgtgatagagtccttggtgggtttagtcatctcggaagtcgtagggcagctatggaaaccactgggttctggaacgttccagccaggcagtggttgttcctcataggtaggtggccttggccttcatcccagcctgggatgctccattgcatttgtcacctagtcactgtatatacgtgcacatttgaccttttggcacagcccaggttccaggtgcgtgacctgccctttttctcattcccttaactgacattatttagtgtcagaggccgagcacagtggctcccacctataatcctagcactttgggaggccaacgcgggtggattgcttgagcccaggagttcaagagcagcctgggcaatatagaaagacctcttccctaccaaaaaaaaaaaaaaaaaaaaaaagccaggtgcagtggctcacgcttgtaatcccagcactttgggaggccgaggcaggtggatcacaaggtcaggagatcgagaccatcctggccaacatggtgaaaccccatctctactaaaaacacaaaaattagctaggcatggtggcgtggcacgtgcctgtagtcccagctactcgggaagctgaggcaagagaatcacttgaaccagggaggcggaggttgcagtgagccgaggtcgcaccgttgtactccagcctggtgatagaacgagactccacacaaaaaaaaaaaaaattagccaggcatgatggggtgtgcctgtagtcccagctacttgagaggctgaggctggaggatcacttgagcccaggaagttgaggctgcagtgagctgtgattgtgccactgcactcatcctggaagacagagtgagatcctgtctcagataaaataaacaattttttttttaagtcattgcttctggcccctgtgtgctctgtcctgtgtctgcagaatggggctgcctggttgagggacggcttttaccttctagactagctctgggatctctcatggggcatgaggtacccagctagatgtggccaggccacactccaggagctagcaaagcacccagcgttgctgacacccatctccccagcgcagcctgagcccccaggcccctctctcatatccaggcctgtgctggaggtggcggcctctgggggagtgtggttggggtctgcccacttccctccccctgccgaggctgtggcctcccactggctgctgcttggccccatctcatggtcgctgcctgctgcttggccccatctcatgggcgtcatcctcagcactcacgtgatgggagagttttgtaggagctgtgagtcccaggtgcctgcgtgtgctgtgatgttatctcatgcagtccagtgaggggggactcccattagtctcctttttttgttttgttttgagacacagtctcacttcattacccaggctggagtgcaaggcacgatcttggctcaccacaacctccacctcccaggttcaagtgattctcctgcctcagcctcctgagtagctgggattacaggtgcgcaccactacgcctggctaatttttgtatttttagtagagatggggtttctccatgttggtcaggctggtcttgaactcccgaccttgtgatccacccacctcggcctcccaaagtgctgggattacaggcgtgagccaccgcgcccggccatgattctccttctgtgggtggaggaactgggcactgggagcgtgaaaaccttgcccaggtggcagagccagctttggacgcaggtctgacttcctacctcactccccttgccttgacagacacagtaattcagagttgaacttggaacagagtttattttccatcactgtaaaacattctcagtgaggttactggcattaaaaaggtgggagaaatggaagaaaatggggttgaagaaaaaaaaagcctttgctcttgacagctaggcagccacagcggaggccgccaggctgcgagggcagcgtatgggggcagagcccggttctggcggcacaggccccggagtggagggggcaggggagggtctctgtaggtgggagagggcctgggggctgggaggcagcctggccttgtgccctacaggagggacctcctgggactttatggaagcctgtcttgcctttgacttgcaatgaaaatgcccctcatcattgggagtggggtcgggtgggggtccccagtggccagatcacgtggggtccagagagcagacatctgtagccctgatcttggcggccagtgaccacggccaagcagggcctgtcttttgcctggtacaaggcttgatgagaagagacccctgcccatcctcagtggcctggcagccaggggtgaaccccaggggaagctgggacactgtcccaaaggcccggcgccctactgtgctgcctgagcccgtggcaccgtggggcccaaggtggtgatgatttctctgctcttcccacggggcagacagcaggacacatcctggagacaaggttggggagacaaacaggtgcccaggtcagggctgatcacagcagttacaaaagcatcccgtgaagacggggctgcaagacggtgctggcaaaggaacaggacccaggaagaccaggcttgtcctgtggaggggccgggtcttggcagggggcaagcagatgtccccagtttttgctggtgatcaacaagtgaggccgctgctccattctacacaggacagcatttccaggggtttccagtattctgtctagattcataaaggtcaaaggccttgagaatctatgtgtgcctttctatcttaggtaaagaagagaaagagaaagcaaattctcgttactcctctttcaaaaagttcattaaaagccaggctggcagctcacagtgctataatcccagcactgtggaaggcctaggcaggaggattgagaggagttccagaccaacctgggcaacaccgtgagaccccatctctac

SEQ ID NO: 202705 - DNA, 2440 bp, Homo sapiens
  Payload ID: 19979
  Gene Name: zinc finger protein 500
  Uniprot ID: O60304
  ENST ID: ENST00000545009
  CDS Start-End: 299-1624
agccaatggtgccacggctacgttacccacaatgccgcctgcgggcccacccgcacggcctggtttgcacccctggtttagggtcttcggccccggctctggcgtccctggctgccaagcctgaggcccgcagtcctactcccgccgagacccgccgctccggtcctgccccgaactgcccacggccggcagcgcttccaggccctgaaaaaaactctcttcctgtgtctggccagaggtatagagagagacaggttcaactctaaggcctgaaaaggaacaaggcccaccggaagcaatggccactgtccctggcctccagcccctgccaaccttggagcaggacctggaacaggaagagatcctgattgtgaaggtggaggaggacttctgcttggaagaggagccctccgtggagacggaggaccccagccctgagactttccgccagctcttccggctcttctgctaccaggaggtggctgggccccgggaggccctgagccgcctctgggagctgtgctgccgctggctgcggccggagctgcgcaccaaggagcagatcctggagctgctggtgctggagcagttcctgactgtgctgccgggggagatccaggctcgggtacgcgagcagcagccggagagcggtgaggaggccgtggtccttgtggaagggctgcagcggaagcccaggaaacacaggcagcggggctcagagctgctttctgatgacgaggtgcccctcgggatagggggacagttcttaaaacaccaggcagaggctcagccagaggatctgtccctggaggaagaggctcgattctccagccagcagcccccagcccagctgagccacaggccacagaggggcccgctgttgtggccagagagaggccctccagctccccggcatcaggagatggcgtcagcctcgcccttcctttcggcctggtcccaggtgcccgtgaacttggaggacgtggctgtatacctttctggggaggagccaagatgcatggacccagctcagcgggacgcgccgctggagaatgaaggacctgggatccagttggaggacggcggtgatggcagggaggatgccccgttgagaatggagtggtaccgagtgctctcggcacgatgccaggggcctggccacccgctcccaggtcagaggccagccccagtcaggggcttggtcaggcctgatcagccaagaggcggccccccaccaggaagacgggcttcccatggggctgacaagccgtacacctgccccgaatgtggcaaaggcttcagcaagacgtcccacttgaccaagcaccagcgcacacacacgggcgagcggccttacaagtgcctagtctgtgggaagggctttagcgaccgctccaacttcagcacgcaccagagggtgcacacaggcgagaagccctacccgtgccccgagtgtgggaagcgcttcagccagagctccagcctggtcatccaccgcaggacacacagcggggagcggccctatgcctgcacccagtgcgggaagcgcttcaacaacagctcgcacttcagcgcccaccgccggacgcacacaggtcacattctgaggtctgggtgcacatgaatttgagggacccctcgtctgctgcagggagccctgctgtaccccagccttcccaggacgtggtctccagcttcttcatcctgccagagtttccaaatggagcccggggctctgcagcattccagtcccctttgcagatccatagctgctctgcagggcggaagacacctggggcgggaaagcacccctgagttccatcttcctgacatgttgcctgggatgtgacgggcctgacatctccccagggccggggcccagggctgcgtttgctcctggccccttagtgtctggaatgtggccttccacggttgccccactttgtctttctaaggtaagaagccttcaccttccagcttttgtctggcctgtgctgcgtgggagccactggtctgtgcacatccacggtgggtgagtggccaagacaagcagtgtgatagagtccttggtgggtttagtcatctcggaagtcgtagggcagctatggaaaccactgggttctggaacgttccagccaggcagtggttgttcctcataggtaggtggccttggccttcatcccagcctgggatgctccattgcatttgtcacctagtcactgtatatacgtgcacatttgaccttttggcacagcccaggttccaggtgcgtgacctgccctttttctcattcccttaactgacattatttagtgtcagaggccgagcacagtggctcccacctataatcctagcactttgggaggccaacgcgggtggattgcttgagcccaggagttcaagagcagcctgggcaatatagaaagacctcttccctacc

SEQ ID NO: 202706 - DNA, 604 bp, Homo sapiens
  Payload ID: 19979
  Gene Name: zinc finger protein 500
  ENST ID: ENST00000592425
  CDS Start-End: 329-604
gcggccgcatcagagacagcccgggccaggtcccatggacaccacctgcaccgtgattgaggaaccctgatctgaagatctctgagcgcacattacctgtggtccagttcattccctgtgcaaaaggcagaagtcaaaagggaaagaatttgccagccctcccggctcccaagtggttacgtggaatcctcagaagggaaggaatgagattctgcccagctctgtccaccagctcctggagcccagacacagcttccctctcagggtcacaggacctgggatccagttggaggacggcggtgatggcagggaggatgccccgttgagaatggagtggtaccgagtgctctcggcacgatgccaggggcctggccacccgctcccaggtcagaggccagccccagtcaggggcttggtcaggcctgatcagccaagaggcggccccccaccaggaagacgggcttcccatggggctgacaagccgtacacctgccccgaatgtggcaaaggcttcagcaagacgtcccacttgaccaagcaccagcgcacacacacgggcgagcggccttacaagtgcctagtctgtgggaagggctttagcgac

SEQ ID NO: 202707 - DNA, 276 bp, Homo sapiens
  Payload ID: 19979
  Gene Name: zinc finger protein 500
  ENST ID: ENST00000588942
  CDS Start-End: 1-220
gtcatccaccgcaggacacacagcggggagcggccctatgcctgcacccagtgcgggaagcgcttcaacaacagctcgcacttcagcgcccaccgccggacgcacacaggtaaagaagagaaagagaaagcaaattctcgttactcctctttcaaaaagttcattaaaagccaggctggcagctcacagtgctataatcccagcactgtggaaggcctaggcaggaggattgagaggagttccagaccaacctgggcaacaccgtgagaccccatc

SEQ ID NO: 202708 - DNA, 1831 bp, Homo sapiens
  Payload ID: 19979
  Gene Name: zinc finger protein 500
  ENST ID: ENST00000589422
  CDS Start-End: 27-455
aaaaggaacaaggcccaccggaagcaatggccactgtccctggcctccagcccctgccaaccttggagcaggacctggaacaggaagagatcctgattgtgaaggtggaggaggacttctgcttggaagaggagccctccgtggagacggaggaccccagccctgagactttccgccagctcttccggctcttctgctaccaggaggtggctgggccccgggaggccctgagccgcctctgggagctgtgctgccgctggctgcggccggagctgcgcaccaaggagcagatcctggagctgctggtgctggagcagttcctgactgtgctgccgggggagatccaggctcgggtacgcgagcagcagccggagagcggtgaggaggccgtggtccttgtggaagggctgcagcggaagcccaggaaacacaggcagcggggggacagttcttaaaacaccaggcagaggctcagccagaggatctgtccctggaggaagaggctcgattctccagccagcagcccccagcccagctgagccacaggccacagaggggcccgctgttgtggccagagagaggccctccagctccccggcatcaggagatggcgtcagcctcgcccttcctttcggcctggtcccaggtgcccgtgaacttggaggacgtggctgtatacctttctggggaggagccaagatgcatggacccagctcagcgggacgcgccgctggagaatgaaggacctgggatccagttggaggacggcggtgatggcagggaggatgccccgttgagaatggagtggtaccgagtgctctcggcacgatgccaggggcctggccacccgctcccaggtcagaggccagccccagtcaggggcttggtcaggcctgatcagccaagaggcggccccccaccaggaagacgggcttcccatggggctgacaagccgtacacctgccccgaatgtggcaaaggcttcagcaagacgtcccacttgaccaagcaccagcgcacacacacgggcgagcggccttacaagtgcctagtctgtgggaagggctttagcgaccgctccaacttcagcacgcaccagagggtgcacacaggcgagaagccctacccgtgccccgagtgtgggaagcgcttcagccagagctccagcctggtcatccaccgcaggacacacagcggggagcggccctatgcctgcacccagtgcgggaagcgcttcaacaacagctcgcacttcagcgcccaccgccggacgcacacaggtgagaagccctacacctgcccggcctgtggccggggcttccgccggggcaccgacctgcacaagcaccagcggacccacatgggggcaggctccttgccgacgctccagccggtggctcctggaggccccggtgccaaagcctgatcaccaggcctgaaactccctttccaggactctcatccctgggcacagaattcaggaaactgctagacagcctggtccgaaagcattgccagctgcccgtttcctcccatggcccagtatgaggccagcaggggacatttgggatgcccaggccgcagaggaagctgggcactgggtgcagaacaagggcaaggacaggctctgagtgtccagtggcagccagaacaggtgacacagagcaggggcttcagccacagagacacactcaggaggccagaagccgacactcaaggtgttcgtggggctggctcctgaagggcctgggagggtccatcagctgcctccagcatccagtggctgctggcatacagcctcatccccacgtcccaacccctctcctgtgtg

SEQ ID NO: 202709 - DNA, 507 bp, Homo sapiens
  Payload ID: 19979
  Gene Name: zinc finger protein 500
  ENST ID: ENST00000588602
  CDS Start-End: 145-507
gatttcgcggcccgcgccagcacccgggtctgtgccgcggcctcggggccctgaaaaaaactctcttcctgtgtctggccagaggtatagagagagacaggttcaactctaaggcctgaaaaggaacaaggcccaccggaagcaatggccactgtccctggcctccagcccctgccaaccttggagcaggacctggaacaggaagagatcctgattgtgaaggtggaggaggacttctgcttggaagaggagccctccgtggagacggaggaccccagccctgagactttccgccagctcttccggctcttctgctaccaggaggtggctgggccccgggaggccctgagccgcctctgggagctgtgctgccgctggctgcggccggagctgcgcaccaaggagcagatcctggagctgctggtgctggagcagttcctgactgtgctgccgggggagatccaggctcgggtacgcgagcagcagccggagagcggtgaggaggcc

SEQ ID NO: 202710 - DNA, 312 bp, Homo sapiens
  Payload ID: 19979
  Gene Name: zinc finger protein 500
  ENST ID: ENST00000585977
  CDS Start-End: 236-312
tcggctcactgcaacctgcgccttagcctcctgagtagctaggattacaggcatgaaccaccacgcccaggtttctccacgttagtcaggctggtctcgaactcccgacctcagatggttttatcgtctctccacagggccctgaaaaaaactctcttcctgtgtctggccagaggtatagagagagacaggttcaactctaaggcctgaaaaggaacaaggcccaccggaagcaatggccactgtccctggcctccagcccctgccaaccttggagcaggacctggaacaggaagagatcctgattgtgaa

SEQ ID NO: 202711 - DNA, 3099 bp, Homo sapiens
  Payload ID: 19980
  Gene Name: zinc finger protein 501
  Uniprot ID: Q96CX3
  ENST ID: ENST00000396048
  CDS Start-End: 438-1253
gactgctgacgtcacgccggctgggcgcgtccgggacttactcctttccgcagggcagcacccagggacctgagtgttgcaaggtgcgagaggggagcgccgcggggagcgccgcgggaagcgcatgtgcctcaaattcctgcctttcctcaagagaagagcccccaggagaaaagccagtattgcttgtgctcctaacaacctgtctcttgagaggctgatcatcaggggttcactttcagagaagttgagaatgcaggctgaacaaggaagaggaaggggaatcctgcagggatgaatgagaggacagcaatgcatgtgtgatgtgtgtgagcacacacacacagtaacctttcctaggagaactgtattactctaatgataatcacctttgaggaaaaaaaacttgtaagtatgaatttggtgttacaagcagcatgaattccagccaaatatcactcagaatgaaacatgggagagttaacatgcagaagaaaccttcaaagtgtagtgaatgtgggaagttctttactcagagatcatctcttacccagcaccagaggattcacagaggagagaagccctatgtgtgcagtgaatgtggaagttgtttccgtaaacagtcaaatcttactcaacatctgagaattcataccggagagaaaccttataaatgtaatgaatgtgagaaagcctttcaaacaaaagcaattcttgttcagcatctgagaattcatactggagagaaaccctataaatgcaatgaatgtggaaaagccttttgtcagagcccatcccttattaaacaccagcgaattcatactggagagaaaccatataaatgtacagaatgtggcaaagccttcagtcagagcatatgccttactcgtcatcagagaagtcattctggagataaaccttttaagtgtaatgaatgtgggaaagcctttaatcagagtgcatgtctcatgcagcatcagagaattcattcaggagagaagccctacacatgcactgaatgtggtaaagccttcactcagaactcttcccttgttgaacatgaaaggactcacactggagagaaactttataagtgtagtgagtgtgaaaaaactttccgcaaacaagcacaccttagtgagcattacagaattcatactggagaaaaaccttatgagtgtgttggatgtgggaaatcctttaggcacagttcagcacttcttcgacatcagaggcttcatgctggagagtaaaatttggaatataatgagtatgggaagatttgtatggaagcaccttttttttctcctaaattcctaggaatgtaagactcaatctgtagctagtatgaatattttgtattttgaacaagaaatgttgtgtcctaatgtgtcctagtctggagtttgatgccttatctgctgctcagtgggtgtaaccttatcccttctgagcctcagtttccccattccccccaatagaaaaatggggatatttcctagggttgtcctgagaataaaatgagttctgtgtgacagttaactgccattaattaattagccgttctaaaagtttatttacaatatcaaaatctgacaagtaaatcagcattgttgtttggttctcataatgtattgtttcttaagaacattttgtaattgggctatgattttatgatctacagacgtctatttaaactataatgtcttggtttaaataggataatacaatctaagactggtttgtccttgagaaatttcagatttaatcagagaaaaatgtactgattgggatttgagtggacattgtggggtgtatttctggataccctcaagatcttcatttaaattttgatactttctattactagatctaatttgattttaagctctaagtttcacttttccattaaacggaaagcctccctgacattaactgaataaaacctcatgttgtgggacttctgtgtgtgtttagggttggcagcaggtgattaggagaaggcatatgacagtagagaggactggaatatagaggagaatataagcatgtagatgaggatgtggctgtatttgttttgagttctaggagcacagcaccaaatgtggtctcttaagggaagatgagggtagaagatgttaagatcccaggttccagcaactgatgccactgactaacaactagccacttgtcagaggaaggagagaacagtgtcttggggatgctgatgggttggagtgcctaatggctcattaaaagccatgaaaaagcaaagaaatcaaagaatacttttgatggagctttaggctatgctaagccttttaatgtaaacaagcacctctaacgctaaaagcacccttgcaagaaaggtaggagttactattcacatcctagagtcaaggaaaaagagaagatgtttgacttgctcaaagtcaagcaggtaatgtcagaattgaatctcaaatctatatctttatagatttgcagttctggtttatataataccaaagtcacatacaggtaatttcccaccattgaaccttcctgttggtgtgagatgccaaatctgtgaaaaccagacacaggtggccaggtgggtgtcgaactcctgacctcaagtgatccgcctgcctcagcctcccaaagtgctgggattacaggtgtgagtcaccacatctggtcggattttaactattctaataggtatgtagtggtattaattgttttaatctgcagttcaccaataatatatgaatttagcatcttttcatatgtttgccatctgtatagctttggtgaggtatctgttagaggttttgcccatttttaattggattgctcattttcttattgttgaattttaagtgttccttgtatattttgtataacagacctttatcagataggtcttttgcaaatattttcctcccaggctgtggcttattttctcaatccttgattccttctctttactttttttttcttttttctttttttaaagaaatggtagcataatatacacagttgtccattttttaaagactaaaccatctcacagattgttctgtatcagtaaataaagatctttcccccaccctt

SEQ ID NO: 202712 - DNA, 3382 bp, Homo sapiens
  Payload ID: 19980
  Gene Name: zinc finger protein 501
  Uniprot ID: Q96CX3
  ENST ID: ENST00000620116
  CDS Start-End: 721-1536
gtcacgccggctgggcgcgtccgggacttactcctttccgcagggcagcacccagggacctgagtgttgcaaggtgcgagaggggagcgccgcggggagcgccgcgggaagcgcatggtgagcggtttctgctgtgcccggctgccgcgggtcgattccagctcctccctcgggaagcagggcgtttttcttcctggagggcctgtggagcggaggcccgaggcctagggcaaacttgccatgaagaaaggagaggctgttcgagagccctaggctgggagtcggaggacctgggttcgatttatacatacttaagcatgtcagtgaacttctgggcactttagttttctgatttccagaagtaaatactgtttcctgccttgccgtttcccaaagttgtgcgggttgaatgcctcaaattcctgcctttcctcaagagaagagcccccaggagaaaagccagtattgcttgtgctcctaacaacctgtctcttgagaggctgatcatcaggggttcactttcagagaagttgagaatgcaggctgaacaaggaagaggaaggggaatcctgcagggatgaatgagaggacagcaatgcatgtgtgatgtgtgtgagcacacacacacagtaacctttcctaggagaactgtattactctaatgataatcacctttgaggaaaaaaaacttgtaagtatgaatttggtgttacaagcagcatgaattccagccaaatatcactcagaatgaaacatgggagagttaacatgcagaagaaaccttcaaagtgtagtgaatgtgggaagttctttactcagagatcatctcttacccagcaccagaggattcacagaggagagaagccctatgtgtgcagtgaatgtggaagttgtttccgtaaacagtcaaatcttactcaacatctgagaattcataccggagagaaaccttataaatgtaatgaatgtgagaaagcctttcaaacaaaagcaattcttgttcagcatctgagaattcatactggagagaaaccctataaatgcaatgaatgtggaaaagccttttgtcagagcccatcccttattaaacaccagcgaattcatactggagagaaaccatataaatgtacagaatgtggcaaagccttcagtcagagcatatgccttactcgtcatcagagaagtcattctggagataaaccttttaagtgtaatgaatgtgggaaagcctttaatcagagtgcatgtctcatgcagcatcagagaattcattcaggagagaagccctacacatgcactgaatgtggtaaagccttcactcagaactcttcccttgttgaacatgaaaggactcacactggagagaaactttataagtgtagtgagtgtgaaaaaactttccgcaaacaagcacaccttagtgagcattacagaattcatactggagaaaaaccttatgagtgtgttggatgtgggaaatcctttaggcacagttcagcacttcttcgacatcagaggcttcatgctggagagtaaaatttggaatataatgagtatgggaagatttgtatggaagcaccttttttttctcctaaattcctaggaatgtaagactcaatctgtagctagtatgaatattttgtattttgaacaagaaatgttgtgtcctaatgtgtcctagtctggagtttgatgccttatctgctgctcagtgggtgtaaccttatcccttctgagcctcagtttccccattccccccaatagaaaaatggggatatttcctagggttgtcctgagaataaaatgagttctgtgtgacagttaactgccattaattaattagccgttctaaaagtttatttacaatatcaaaatctgacaagtaaatcagcattgttgtttggttctcataatgtattgtttcttaagaacattttgtaattgggctatgattttatgatctacagacgtctatttaaactataatgtcttggtttaaataggataatacaatctaagactggtttgtccttgagaaatttcagatttaatcagagaaaaatgtactgattgggatttgagtggacattgtggggtgtatttctggataccctcaagatcttcatttaaattttgatactttctattactagatctaatttgattttaagctctaagtttcacttttccattaaacggaaagcctccctgacattaactgaataaaacctcatgttgtgggacttctgtgtgtgtttagggttggcagcaggtgattaggagaaggcatatgacagtagagaggactggaatatagaggagaatataagcatgtagatgaggatgtggctgtatttgttttgagttctaggagcacagcaccaaatgtggtctcttaagggaagatgagggtagaagatgttaagatcccaggttccagcaactgatgccactgactaacaactagccacttgtcagaggaaggagagaacagtgtcttggggatgctgatgggttggagtgcctaatggctcattaaaagccatgaaaaagcaaagaaatcaaagaatacttttgatggagctttaggctatgctaagccttttaatgtaaacaagcacctctaacgctaaaagcacccttgcaagaaaggtaggagttactattcacatcctagagtcaaggaaaaagagaagatgtttgacttgctcaaagtcaagcaggtaatgtcagaattgaatctcaaatctatatctttatagatttgcagttctggtttatataataccaaagtcacatacaggtaatttcccaccattgaaccttcctgttggtgtgagatgccaaatctgtgaaaaccagacacaggtggccaggtgggtgtcgaactcctgacctcaagtgatccgcctgcctcagcctcccaaagtgctgggattacaggtgtgagtcaccacatctggtcggattttaactattctaataggtatgtagtggtattaattgttttaatctgcagttcaccaataatatatgaatttagcatcttttcatatgtttgccatctgtatagctttggtgaggtatctgttagaggttttgcccatttttaattggattgctcattttcttattgttgaattttaagtgttccttgtatattttgtataacagacctttatcagataggtcttttgcaaatattttcctcccaggctgtggcttattttctcaatccttgattccttctctttactttttttttcttttttctttttttaaagaaatggtagcataatatacacagttgtccattttttaaagactaaaccatctcacagattgttctgtatcagtaaataaagatctttcccccaccctt

SEQ ID NO: 202713 - DNA, 3382 bp, Homo sapiens; identical to SEQ ID NO: 202712
  Payload ID: 19980
  Gene Name: Zinc finger protein 501
  ENST ID: ENST00000625592
  CDS Start-End: 721-1536

SEQ ID NO: 202714 - DNA, 3099 bp, Homo sapiens; identical to SEQ ID NO: 202711
  Payload ID: 19980
  Gene Name: Zinc finger protein 501
  ENST ID: ENST00000627775
  CDS Start-End: 438-1253

SEQ ID NO: 202715 - DNA, 3270 bp, Homo sapiens
  Payload ID: 19981
  Gene Name: zinc finger protein 502
  Uniprot ID: Q8TBZ5
  ENST ID: ENST00000296091
  CDS Start-End: 257-1891
attcttccggtttcagaagttaaggctggtgtcctggccccagtccacctctgggagcgcctgcgccgctccgcggagagtccgtggatctcacagtgaaaaatgtttgctgacccttgacattgacaaactgctgacagctcagatgatccatgattggaaggatgtggtcatcaccaagatgtctttctttctccggttcccagttttccagacctgaagtgttttccaatcaaagcgaagagacgatctgtggatgttgaatatgcaaggagctgaagagagagacattagaagagagacttgtccaggctgggtaaacaagaacaagcctgctctggagcaggatgtctgtaaaattgactcatcagggatagtagtaaagaggttccaagaggatgaataccaagattctacatttgaagaaaaatatgcatgtgagggcatgaaggaaaactctcctagggagattgctgaatcatgccttttccaggaaggaggttttgggagaataactttcatccacaaagaagcaccccctgaaattattagtcaaggatataattttgagaaaagcttgcttttgacctcaagccttgttacacgtctcagggtttctacagaagagagtctgcatcagtgggaaacaagtaatatacaaaccaatgatatttcagaccaaagtaaatgtccaactctctgcacacagaaaaaatcttggaaatgtaatgaatgtggaaaaacctttactcagagctcatcccttacccaacatcagagaactcatactggagagagaccctacacatgtgaggaatgtgggaaagcctttagtcgtagttcattccttgttcaacatcaaagaattcacactggagtgaaaccatatggatgtgagcagtgtgggaaaacatttcgatgtcgatcatttcttactcagcatcaaagaattcacactggagagaaaccttataaatgcaatgaatgtgggaattccttccgcaatcactcacatctcactgaacaccagagaattcacactggagagaaaccttataaatgcaataggtgtgggaaggcattcaatcagaatacacaccttattcatcatcagagaattcacactggtgagaagccttacatatgcagtgaatgtggctcttcttttcgaaaacactcaaatcttacgcaacatcagagaattcacactggggaaaaaccccataaatgtgacgaatgtgggaaaactttccaaacaaaggcaaacctctctcagcatcagagaattcatagtggagagaaaccctataaatgtaaagaatgtggcaaagccttttgtcagagcccatctcttattaaacaccagcgaattcatactggagaaaaaccatataagtgtaaagaatgtggcaaagcgtttactcagagcaccccactcactaaacatcagagaatacatacaggggagagaccctacaaatgcagtgaatgtggtaaagccttcattcagagcatttgccttattcggcaccagagaagtcacactggagaaaaaccctataaatgcaatgaatgtggaaagggctttaatcagaacacctgcctcactcagcatatgagaattcatactggagagaagccctataaatgtaaagaatgtgggaaagcctttgctcatagctcatctcttactgaacatcatagaactcacactggtgagaagctctataaatgtagtgagtgtgagaaaaccttccgcaagtatgcacaccttagtgaacattacagaattcacactggtgagaagccttatgagtgtattgagtgtggaaagttcttcagacatagttcagtccttttcagacatcagaaacttcacagtggtgactaatgctgccatttaggttatgacagtttctctagcgaggatgactacgaatctgactgggagtagaggggcaggtagagttcctggagggaaggatgaaggagccttggctactgtactctgagaggaatgtttccagaaatggaggtgggagcttagggaatgcagagcctacttgaggtgggcatctgggaatacagggtagaaagaaattcctgcttttcagataaagcctacacattgccactgtctccccatgtgactcttacagcttgaggaggcatttgttagcacttctgttcactttactacatcctgccccacattctgacttgtcacccattttcgttggctggcaggttgagatgtttttcttaaacactgcctgtcagtgtgaagtggcacagctctgatgtagtgctaagtctagcctccagatttgaggcagccctgaccatgctaccatgggggaggctcccaacctgtggaagtggtcctgtgaaaaggagacagaaacaagtaagagccaaaaaaaaaaaaaaaaaaaatccatatccattcattaaaaaaatgagatataaagcaacaactgggctgacctctatagatctgccagtaaagaaggctttctttcattatcagggtgaaggtctttcctgattcttccaagctttgaggtgactcagagctaagaatgaaataggagaccaagttagaattcatgatactggtttatggggaggcagtcatacctgttcagagaaccaggaagactcaatatctatctcagaggaaatatggttacccaggaaagaaatggtctgctagagtgataagactcagaacaggaagcctgcatgtgactgagcaagtcacctacataaccctgcctgtactaaggtgtacacctgtctattgtaagtttgcctaggctgttggtgtacagagaccagaggagagagacacactaggactaacaatgtcctaacaaaatggtacttagtttgttggtctttaggagaaagcattagtaatgaaagaagaaagaattttcacttggttggacattggggctcttaagaaagttgacatttgtcgtggaatgactttggaaagacttctaaaagaatctttttcaaatccctgaaaatcaggatagcacattttgctactgactgtgacagtgttttattcttttgagagaaatgacatagttttccctttatttcccaaattcctttcatgttcttaactgctacccagaaattgagcttcagaagattgaggatagcctttgattggtatttaaaataatttctaagctgtgaagcttatagcatttttaaagtatggctattaaaaacactaagttgattctggaa

SEQ ID NO: 202716 - DNA, 3173 bp, Homo sapiens
  Payload ID: 19981
  Gene Name: zinc finger protein 502
  Uniprot ID: Q8TBZ5
  ENST ID: ENST00000449836
  CDS Start-End: 162-1796
accattcttccggtttcagaagttaaggctggtgtcctggccccagtccacctctgggagcgcctgcgccgctccgcggagagtccgtggatctcacagtgaggttcccagttttccagacctgaagtgttttccaatcaaagcgaagagacgatctgtggatgttgaatatgcaaggagctgaagagagagacattagaagagagacttgtccaggctgggtaaacaagaacaagcctgctctggagcaggatgtctgtaaaattgactcatcagggatagtagtaaagaggttccaagaggatgaataccaagattctacatttgaagaaaaatatgcatgtgagggcatgaaggaaaactctcctagggagattgctgaatcatgccttttccaggaaggaggttttgggagaataactttcatccacaaagaagcaccccctgaaattattagtcaaggatataattttgagaaaagcttgcttttgacctcaagccttgttacacgtctcagggtttctacagaagagagtctgcatcagtgggaaacaagtaatatacaaaccaatgatatttcagaccaaagtaaatgtccaactctctgcacacagaaaaaatcttggaaatgtaatgaatgtggaaaaacctttactcagagctcatcccttacccaacatcagagaactcatactggagagagaccctacacatgtgaggaatgtgggaaagcctttagtcgtagttcattccttgttcaacatcaaagaattcacactggagtgaaaccatatggatgtgagcagtgtgggaaaacatttcgatgtcgatcatttcttactcagcatcaaagaattcacactggagagaaaccttataaatgcaatgaatgtgggaattccttccgcaatcactcacatctcactgaacaccagagaattcacactggagagaaaccttataaatgcaataggtgtgggaaggcattcaatcagaatacacaccttattcatcatcagagaattcacactggtgagaagccttacatatgcagtgaatgtggctcttcttttcgaaaacactcaaatcttacgcaacatcagagaattcacactggggaaaaaccccataaatgtgacgaatgtgggaaaactttccaaacaaaggcaaacctctctcagcatcagagaattcatagtggagagaaaccctataaatgtaaagaatgtggcaaagccttttgtcagagcccatctcttattaaacaccagcgaattcatactggagaaaaaccatataagtgtaaagaatgtggcaaagcgtttactcagagcaccccactcactaaacatcagagaatacatacaggggagagaccctacaaatgcagtgaatgtggtaaagccttcattcagagcatttgccttattcggcaccagagaagtcacactggagaaaaaccctataaatgcaatgaatgtggaaagggctttaatcagaacacctgcctcactcagcatatgagaattcatactggagagaagccctataaatgtaaagaatgtgggaaagcctttgctcatagctcatctcttactgaacatcatagaactcacactggtgagaagctctataaatgtagtgagtgtgagaaaaccttccgcaagtatgcacaccttagtgaacattacagaattcacactggtgagaagccttatgagtgtattgagtgtggaaagttcttcagacatagttcagtccttttcagacatcagaaacttcacagtggtgactaatgctgccatttaggttatgacagtttctctagcgaggatgactacgaatctgactgggagtagaggggcaggtagagttcctggagggaaggatgaaggagccttggctactgtactctgagaggaatgtttccagaaatggaggtgggagcttagggaatgcagagcctacttgaggtgggcatctgggaatacagggtagaaagaaattcctgcttttcagataaagcctacacattgccactgtctccccatgtgactcttacagcttgaggaggcatttgttagcacttctgttcactttactacatcctgccccacattctgacttgtcacccattttcgttggctggcaggttgagatgtttttcttaaacactgcctgtcagtgtgaagtggcacagctctgatgtagtgctaagtctagcctccagatttgaggcagccctgaccatgctaccatgggggaggctcccaacctgtggaagtggtcctgtgaaaaggagacagaaacaagtaagagccaaaaaaaaaaaaaaaaaaaatccatatccattcattaaaaaaatgagatataaagcaacaactgggctgacctctatagatctgccagtaaagaaggctttctttcattatcagggtgaaggtctttcctgattcttccaagctttgaggtgactcagagctaagaatgaaataggagaccaagttagaattcatgatactggtttatggggaggcagtcatacctgttcagagaaccaggaagactcaatatctatctcagaggaaatatggttacccaggaaagaaatggtctgctagagtgataagactcagaacaggaagcctgcatgtgactgagcaagtcacctacataaccctgcctgtactaaggtgtacacctgtctattgtaagtttgcctaggctgttggtgtacagagaccagaggagagagacacactaggactaacaatgtcctaacaaaatggtacttagtttgttggtctttaggagaaagcattagtaatgaaagaagaaagaattttcacttggttggacattggggctcttaagaaagttgacatttgtcgtggaatgactttggaaagacttctaaaagaatctttttcaaatccctgaaaatcaggatagcacattttgctactgactgtgacagtgttttattcttttgagagaaatgacatagttttccctttatttcccaaattcctttcatgttcttaactgctacccagaaattgagcttcagaagattgaggatagcctttgattggtatttaaaataatttctaagctgtgaagcttatagcatttttaaagtatggctattaaaaacactaagttgattctgg

SEQ ID NO: 202717 - DNA, 593 bp, Homo sapiens
  Payload ID: 19981
  Gene Name: zinc finger protein 502
  ENST ID: ENST00000411443
  CDS Start-End: 129-593
gtcctggccccagtccacctctgggagcgcctgcgccgctccgcggagagtccgtggatctcacagtgaggttcccagttttccagacctgaagtgttttccaatcaaagcgaagagacgatctgtggatgttgaatatgcaaggagctgaagagagagacattagaagagagacttgtccaggctgggtaaacaagaacaagcctgctctggagcaggatgtctgtaaaattgactcatcagggatagtagtaaagaggttccaagaggatgaataccaagattctacatttgaagaaaaatatgcatgtgagggcatgaaggaaaactctcctagggagattgctgaatcatgccttttccaggaaggaggttttgggagaataactttcatccacaaagaagcaccccctgaaattattagtcaaggatataattttgagaaaagcttgcttttgacctcaagccttgttacacgtctcagggtttctacagaagagagtctgcatcagtgggaaacaagtaatatacaaaccaatgatatttcagaccaaagtaaatgtccaactctctgcacacagaaaaaatcttgg

SEQ ID NO: 202718 - DNA, 2314 bp, Homo sapiens
  Payload ID: 19981
  Gene Name: zinc finger protein 502
  Uniprot ID: Q8TBZ5
  ENST ID: ENST00000436624
  CDS Start-End: 155-1789
attcttccggtttcagaagttaaggctggtgtcctggccccagtccacctctgggagcgcctgcgccgctccgcggagagtccgtggatctcacaggttcccagttttccagacctgaagtgttttccaatcaaagcgaagagacgatctgtggatgttgaatatgcaaggagctgaagagagagacattagaagagagacttgtccaggctgggtaaacaagaacaagcctgctctggagcaggatgtctgtaaaattgactcatcagggatagtagtaaagaggttccaagaggatgaataccaagattctacatttgaagaaaaatatgcatgtgagggcatgaaggaaaactctcctagggagattgctgaatcatgccttttccaggaaggaggttttgggagaataactttcatccacaaagaagcaccccctgaaattattagtcaaggatataattttgagaaaagcttgcttttgacctcaagccttgttacacgtctcagggtttctacagaagagagtctgcatcagtgggaaacaagtaatatacaaaccaatgatatttcagaccaaagtaaatgtccaactctctgcacacagaaaaaatcttggaaatgtaatgaatgtggaaaaacctttactcagagctcatcccttacccaacatcagagaactcatactggagagagaccctacacatgtgaggaatgtgggaaagcctttagtcgtagttcattccttgttcaacatcaaagaattcacactggagtgaaaccatatggatgtgagcagtgtgggaaaacatttcgatgtcgatcatttcttactcagcatcaaagaattcacactggagagaaaccttataaatgcaatgaatgtgggaattccttccgcaatcactcacatctcactgaacaccagagaattcacactggagagaaaccttataaatgcaataggtgtgggaaggcattcaatcagaatacacaccttattcatcatcagagaattcacactggtgagaagccttacatatgcagtgaatgtggctcttcttttcgaaaacactcaaatcttacgcaacatcagagaattcacactggggaaaaaccccataaatgtgacgaatgtgggaaaactttccaaacaaaggcaaacctctctcagcatcagagaattcatagtggagagaaaccctataaatgtaaagaatgtggcaaagccttttgtcagagcccatctcttattaaacaccagcgaattcatactggagaaaaaccatataagtgtaaagaatgtggcaaagcgtttactcagagcaccccactcactaaacatcagagaatacatacaggggagagaccctacaaatgcagtgaatgtggtaaagccttcattcagagcatttgccttattcggcaccagagaagtcacactggagaaaaaccctataaatgcaatgaatgtggaaagggctttaatcagaacacctgcctcactcagcatatgagaattcatactggagagaagccctataaatgtaaagaatgtgggaaagcctttgctcatagctcatctcttactgaacatcatagaactcacactggtgagaagctctataaatgtagtgagtgtgagaaaaccttccgcaagtatgcacaccttagtgaacattacagaattcacactggtgagaagccttatgagtgtattgagtgtggaaagttcttcagacatagttcagtccttttcagacatcagaaacttcacagtggtgactaatgctgccatttaggttatgacagtttctctagcgaggatgactacgaatctgactgggagtagaggggcaggtagagttcctggagggaaggatgaaggagccttggctactgtactctgagaggaatgtttccagaaatggaggtgggagcttagggaatgcagagcctacttgaggtgggcatctgggaatacagggtagaaagaaattcctgcttttcagataaagcctacacattgccactgtctccccatgtgactcttacagcttgaggaggcatttgttagcacttctgttcactttactacatcctgccccacattctgacttgtcacccattttcgttggctggcaggttgagatgtttttcttaaacactgcctgtcagtgtgaagtggcacagctctgatgtagtgctaagtctagcctccagatttgaggcagccctgaccatgctaccatgggggaggctcccaacctgtggaagtggtcctgtgaaaaggagacagaaacaagtaagagcc

SEQ ID NO: 202719 - DNA, 2314 bp, Homo sapiens; identical to SEQ ID NO: 202718
  Payload ID: 19981
  Gene Name: Zinc finger protein 502
  ENST ID: ENST00000628995
  CDS Start-End: 155-1789

SEQ ID NO: 202720 - DNA, 3173 bp, Homo sapiens; identical to SEQ ID NO: 202716
  Payload ID: 19981
  Gene Name: Zinc finger protein 502
  ENST ID: ENST00000630464
  CDS Start-End: 162-1796

SEQ ID NO: 202721 - DNA, 3270 bp, Homo sapiens; identical to SEQ ID NO: 202715
  Payload ID: 19981
  Gene Name: Zinc finger protein 502
  ENST ID: ENST00000626630
  CDS Start-End: 257-1891

SEQ ID NO: 202722 - DNA, 593 bp, Homo sapiens; identical to SEQ ID NO: 202717
  Payload ID: 19981
  Gene Name: Zinc finger protein 502
  ENST ID: ENST00000629892
  CDS Start-End: 129-593

SEQ ID NO: 202723 - DNA, 3347 bp, Homo sapiens
  Payload ID: 19982
  Gene Name: zinc finger protein 503
  Uniprot ID: Q96F45
  ENST ID: ENST00000372524
  CDS Start-End: 488-2428
ctggcagcggcggcggcggcggcgcgggacgcgtcacatccccttgaccctccaatcacctcgggctcccatttgattggaaggcggcaaaggctttaatctcccccttggtgcagctgcttttgaagtgagtttcctcgccagagccccggctggacacgcagcggctcgcatcgcagagcgcagcgccggcgcggggccgcgagaacgcagcgcaggggagcagcccgaggcggacaccgcgagccgcccggcactcccgcagtccagccggctcctctagcccggccacggctccgctgcgggccacccaggattactcgcgtctggctccaggcgccgagaaggcgcgctgggcgcccgtggccgccgcgccagctcctcctcctcccgctgctcctgctcccggggcgagcgcgcagccccgagcccgccccgcgcctcccggagccctcccccccgctgctcccatgcgcgcgggtgggtcatgagcacagcgccctcgctttctgccctaagaagcagtaagcacagcggcggcggcggcggcggaggcggaggcggcggtgcagaccctgcctggaccagcgcgctctctggaaatagctccggccccggcccaggctcgtccccggccggcagcaccaagccttttgtgcacgccgtgcccccctctgaccccctgcgccaggccaaccgcctgccaatcaaggtgctgaagatgctgacggcacgaactggccacattttgcaccccgagtacctgcagcccctgccttccacgccggtcagccccatcgagctcgatgccaagaagagcccgctggcgctgttggcgcaaacatgttcgcagatcgggaagcccgacccctcgccctcctccaaactctcctcggttgcctccaacgggggcggcgcgggcggtgccggcggcggtgctgcgggcgacaaggacaccaaatcgggccccctgaagctgagcgacatcggcgtggaggacaagtcgagtttcaagccgtactccaaacccggctcggataagaaggagccgggaggcggcggtggaggcggtggcggtggcgggggcggcggcgggggtgtttcgtcggagaagtcgggattccgggtaccgagcgccacctgccagccattcacgcccaggacaggcagcccgagctccagcgcctcggcctgctcgccgggaggtatgctgtcctcggccgggggtgccccggagggcaaggacgacaagaaagacaccgacgtgggcggcggtggcaagggcaccgggggcgcctcggccgaagggggacccacggggctggcacacggccggattagctgcggcggcgggattaatgtggatgtgaaccagcatccggatgggggcccgggaggcaaggctctgggctcggactgcggcggttcatcgggctccagctccggctccggccccagcgcgcccacctcctcctcagtgttgggctctgggctggtggctcccgtgtcaccctacaagccgggccagacagtgttccctctgcctcccgcgggtatgacctacccaggcagcctggccggggcctacgccggctacccgccccagttcctgccacacggcgtggcacttgaccccaccaagccgggcagcctggtgggggcgcagctggcggcggccgcggccgggtctctgggctgcagtaagccggccggctccagccctttggccggagcgtctccgccgtccgtgatgacagccagtttgtgccgggacccttactgcctcagctaccactgcgctagccacctggcaggggcggcggccgccagcgcttcttgcgcacatgatccggctgctgcggctgcggcgctgaagtccggatacccgctggtgtaccccacgcacccgctgcacggtgtgcactcctcgctaacggccgccgcggctgctggcgccacaccgccctccctggccggccaccccctctacccctacggctttatgctccctaacgacccactcccccacatctgcaactgggtgtcggccaacgggccgtgcgacaagcgcttcgccacgtccgaagagctgctgagccacttgcggacccatacggcatttcccgggacagacaaactgctgtcgggctaccccagctcgtcgtctctggccagcgctgccgcggccgccatggcttgccacatgcacatccccacctcgggcgcaccgggcagccctgggacgctggcgctgcgcagcccccaccacgcgctgggactcagcagccgctaccacccctactccaagagcccgcttcccacgcctggcgcccccgtgccggtgcccgccgccaccggaccgtactactccccctacgccctctacggacagagactgaccaccgcctcggcgctggggtatcagtgagggcggccgggagggcgagcgagggagaggagggagagggggaggggaggagtccagggagaggcgggatcacggcccaggctgctgacacccgcgcgtggggaggactcgggccacgaaaggaaagaaatgtataccgtatctatctacccgacagcagcgaccgagacccggtgggacactccccttctccccactttcacctccccacccaaactttataaaagttgaaaaaatatcatttgactttttatagaaaaaaaaaggaaaaaataattgagaaagtgttcatctgaggactgcatcggtggacactggtatttatttatgttagctccaagcggaccggtggttcaaaagtgcattatttagtttgagctctgtaggtaaaaaggaggtgggaaaaattttaaaacttgagggtaaaaatgtggaaaacaaaccctcccatcccttgtagattataaataaaagcaaaaccgccacagaactagaggtcttctctttaatgttactttaaaattgctatgattgtattgtacgttatttaatgtctgattgaaacacaaatttacatgcatgtttgttacaaaaaaaatgaaaaaaaaagtcacaatttgtcagctctgatttcaaattgcaattatttttaaggtgtataccatcgaagagaatgggtatttttttgtatgtattctggaagaaaacaacaaaaaaaaaaagaaaaagaaaaaattctattccaaaacctcatttgccttattttgttctttaaaaggaacacttaactatttttaatttttaagtccacccgctgagaaggggacaaggtttacgtcatgtactaaaataatagacaatgtatcgctttaaagattaaaattccgtatatttgatgtattaaagggttttacttctt

SEQ ID NO: 202724 - DNA, 1442 bp, Homo sapiens
  Payload ID: 19982
  Gene Name: zinc finger protein 503
  ENST ID: ENST00000535216
  CDS Start-End: 337-1188
gctggacacgcagcggctcgcatcgcagagcgcagcgccggcgcggggccgcgagaacgcagcgcaggggagcagcccgaggcggacaccgcgagccgcccggcactcccgcagtccagccggctcctctagcccggccacggctccgctgcgggccacccaggattactcgcgtctggctccaggcgccgagaaggcgcgctgggcgcccgtggccgccgcgccagctcctcctcctcccgctgctcctgctcccggggcgagcgcgcagccccgagcccgccccgcgcctcccggagccctcccccccgctgctcccatgcgcgcgggtgggtcatgagcacagcgccctcgctttctgccctaagaagcagtaagcacagcggcggcggcggcggcggaggcggaggcggcggtgcagaccctgcctggaccagcgcgctctctggaaatagctccggccccggcccaggctcgtccccggccggcagcaccaagccttttgtgcacgccgtgcccccctctgaccccctgcgccaggccaaccgcctgccaatcaaggtgctgaagatgctgacggcacgaactggccacattttgcaccccgagtacctgcagcccctgccttccacgccggtcagccccatcgagctcgatgccaagaagagcccgctggcgctgttggcgcaaacatgttcgcagatcgggaagcccgacccctcgcccgccctggccggccaccccctctacccctacggctttatgctccctaacgacccactcccccacatctgcaactgggtgtcggccaacgggccgtgcgacaagcgcttcgccacgtccgaagagctgctgagccacttgcggacccatacggcatttcccgggacagacaaactgctgtcgggctaccccagctcgtcgtctctggccagcgctgccgcggccgccatggcttgccacatgcacatccccacctcgggcgcaccgggcagccctgggacgctggcgctgcgcagcccccaccacgcgctgggactcagcagccgctaccacccctactccaagagcccgcttcccacgcctggcgcccccgtgccggtgcccgccgccaccggaccgtactactccccctacgccctctacggacagagactgaccaccgcctcggcgctggggtatcagtgagggcggccgggagggcgagcgagggagaggagggagagggggaggggaggagtccagggagaggcgggatcacggcccaggctgctgacacccgcgcgtggggaggactcgggccacgaaaggaaagaaatgtataccgtatctatctacccgacagcagcgaccgagacccggtgggacactccccttctccccactttcacctccccacccaaactttataaaagttgaaaaaatatcatttgactttttat

SEQ ID NO: 202725 - DNA, 4095 bp, Homo sapiens
  Payload ID: 19983
  Gene Name: zinc finger protein 506
  Uniprot ID: Q5JVG8
  ENST ID: ENST00000443905
  CDS Start-End: 107-1441
ctgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgtgaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtagatggagtctcggtctttcacccaggctggagtgctgtggcacgatctcggctcactgcaacctccacctcccaggttcacaccattctcctgcctcagcttcctgagtagctgggactacaggcacccgccaccatgcccggctaatttttttgtatttttagtagagatggggtttcactgtgttagccgggatggtcaatctcctgaccttgtgatccgcccacctcggcctcccaaagtgctgggattacaggcgtgagccaccgcacctggccattatgccactaactttaacctatcccaccttaatcaagggtgtacttaaaagatggtaacaatatactgtttggtacgtagtggaataacatctctacttgtcactttgccagtggctttaaactgcaaatgagttgaattgttcccatagcttaaattttttttcttattgaaatctattactagtatttgtgggtatacagtatgtgtatatctttatgccttatatggcatattttgattcaggcctacaatatgtagtaattacattagggtaaagtatccatcacctctagcatttatcctttgaattacagtgtaattatacatttttaattattttaaaatgtacaattaaattgttactgactacaggtttatttttatggtcataataaaaattatacagaaaaataaataaaatatggccaggtgcagtggctcaggcctgtaatcccagcactttccaaggcaggtggattgtctgaggtcaggagttcaagaccatcctggccaacatagtgaaaccccgtctgaggaagcgctcctttcgcgggggcactcgctgtggatgaataaagtacactgacacacattctgctctgccagtccagctgagggtccgagccgcttacaggctccaaggccaggcacggtggctcatgcctataattccagcactttggagggccaaggcaggcggatcatctgaggtcaggagttcacgcaaatcagggggcccgtgaaaggcaactgagcagggatccatgggaaagacaccctcagaggcacaagattctctcgttacctttcagtttgctgatacttcagttaaagtctcctgggaaacgtctgcattaggttcttcctctgtagttcttcttaccttgcctgtaaaacaaaacctatctagtgtctgcataggtttccacttcttgtccccacctgaggaatggaaagcaacggcacagtccttgctcatgttttggagtgaaaggagcttgaaggtcatgtgagctttgccaaggcttctcctggcctcatgtcagatacagctcctaactcccaagcagcctaccatagtgtcctcctttttttgcgtgtgtgatggggtttcgcacttgttgcccaggctggagtgcaatggtacaatctcggctcactgcaacctccgcctcccaggttcaagtgattcttctgcctcagcctctcaagtaactgggattacaggcatgcgccactaagggaggagaccactcctcatattgtcttatgcccaatttctgcttccaaagaaagaagaagtaaaaactaaaaggcagaaatgaaatccacaggcagacagcccagcgccacaccatgggcctggtagttaaagatcgagccctgacctaatcggttatgttatctacagattacagacattgtatagaaaagcactttgaaaatccctgtcctgttctgttccattctaattactggtgcatgcagccttcagtcacttactccctgcttgctcaatcgatcacgaccctctcatgcaaacccccttagagttgtaagcccttaagagggataggaattgctcactcagggagctcagtttttgagacgtgagtcttgccaatgctcccggccgaataaagcccttccttctt

SEQ ID NO: 202726 - DNA, 1385 bp, Homo sapiens
  Payload ID: 19983
  Gene Name: zinc finger protein 506
  Uniprot ID: Q5JVG8
  ENST ID: ENST00000450683
  CDS Start-End: 147-1385
ttgtctctcgctgacgccagagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttgttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataa

SEQ ID NO: 202727 - DNA, 1424 bp, Homo sapiens
  Payload ID: 19983
  Gene Name: zinc finger protein 506
  Uniprot ID: Q5JVG8
  ENST ID: ENST00000540806
  CDS Start-End: 90-1424
ctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataa

SEQ ID NO: 202728 - DNA, 1007 bp, Homo sapiens
  Payload ID: 19983
  Gene Name: zinc finger protein 506
  ENST ID: ENST00000545006
  CDS Start-End: 120-356
gctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccaggtggtctataaagaggaatgttttatgagctattgagaaggctatgtatcctgatgatgttgaggagtgttctctataccttcattagaaataattgttttttactgccttctagtcctctgttcccttactaatatactgtcttgttttattattattacagaaagtggggtattgaaatatcctactataattatattgctctattcaactttgttagtatttgctttatatatttgaaaccccaatttgagacacacacacgcacaaatacacacatggataaacaaatttgtcataggtttccatgaattaatctatatattgtttaatgtccttcttttttgaagttttaacttaaagtacattttataaaatatgacagcttttgactttaacaatgtagcttgtgtaatattattttgacctcttctgctctcattttgttagtatttacatgaaatttctacttggtcttgccactttcagtcttttcttatcattagatctcagctgactcttgtaaaaaggcaagttgagtcttgatttttaaaattttttaatgagcctttttagaagtatgtctcttgattggaaagataattatatttaaatagttttctgaaagagaaaaacttactgttaataaaataattgttttg

SEQ ID NO: 202729 - DNA, 892 bp, Homo sapiens
  Payload ID: 19983
  Gene Name: zinc finger protein 506
  ENST ID: ENST00000586260
  CDS Start-End: 130-543
cagagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagatggagtctcggtctttcacccaggctggagtgctgtggcacgatctcggctcactgcaacctccacctcccaggtggattgtctgaggtcaggagttcaagaccatcctggccaacatagtgaaaccccgtctgaggaagcgctcctttcgcgggggcactcgctgtggatgaataaagtacactgacacacattctgctctgccagtccagctgagggtccgagccgcttacaggctccaaggccaggcacggtggctcatgcctataattccagcactttggagggccaaggcaggcggatcatctgaggtcaggagttcacgcaaatcagggggcccgtgaaaggcaactgagcagggatccatgggaaagacaccctcagaggcacaagattctctcgttacctttcagtttgctgatacttcagttaaagtctcctgggaaacgtctgcattaggttcttcctctgtagttcttcttaccttgcctgtaaaacaaaacctatctagtgtctgcataggtttccacttcttg

SEQ ID NO: 202730 - DNA, 575 bp, Homo sapiens
  Payload ID: 19983
  Gene Name: zinc finger protein 506
  ENST ID: ENST00000587452
  CDS Start-End: 108-386
actgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagagacggggtttcaccgtgttagccaggatggtctccatctcctgaccttgtgatccgcccgcctcggcctcccaaagtgctgggattacaggcgtgagccaccgtgcctggcctcggatattttcttagtagtaccttgggggattatctaaaacctctaaaagatccaacaatatattttaatgtagtaaaaaattaacttcagttgcatacagaaattcctcattattacatctaccttc

SEQ ID NO: 202731 - DNA, 429 bp, Homo sapiens
  Payload ID: 19983
  Gene Name: zinc finger protein 506
  ENST ID: ENST00000590766
  CDS Start-End: 108-429
actgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagatggagtctcggtctttcacccaggttgcagtgagctgagatcacgccactgcattccagtctgggcaacagagcaagactctatttcaaaaaaaa

SEQ ID NO: 202732 - DNA, 4140 bp, Homo sapiens
  Payload ID: 19983
  Gene Name: zinc finger protein 506
  Uniprot ID: Q5JVG8
  ENST ID: ENST00000591639
  CDS Start-End: 149-1483
cattgtctctcgctgacgccagagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactggagagaaaccctacaaatgtgaagaatgtggcaaagcctataagcagtcctgtaaccttactacacataagataattcatactggagagaaaccctacagatgtagagaatgtggcaaagcttttaaccaccctgcaacccttttttcacataagaaaattcatactggagagaaaccatacaagtgtgataaatgtggcaaagcctttatttcatcctcaacccttactaaacatgagataattcatactggagagaaaccctacaaatgtgaggaatgtggcaaagcttttaaccgttcctcaaaccttactaaacataagagaattcatactggagatgtaccctacaaatgtgacgaatgtggcaaaacctttacctggtactcaagcctctctaaacataagagagctcatactggagagaaaccctacaagtgtgaagaatgtggcaaagcctttactgcattctcaactctaactgaacataagataattcatactggagagaaaccgtacaaatgtgaagaatgtggcaaagcttttaactggtcctcagcccttaataaacataagaaaattcatattagacagaaaccctgcatagtgaagaatgtggaaaatcttttaaatgttcctcaacccttaataagcataagataattcatactggagagaaaccgtatgaatgtgatgaatgtgggaaagcctttaactagccctggactctgactaaatatgagaatttatatggaacataaaccctacaaatataaagaatgtgacaaagctttttaaggaagttctcaacccttattacacataatttatactggacagaaaccctacaagtgtgaagaatatggcaaagcctataacaacctgtcaactctttttgttttttgagatggagtttcactcttgtcacccaggctggagtgcaatggcacgatctcagctcactgcaacttctgcctcctggtatcaagccattctcctgcctcagcctcccgagtagctgggattactggtgcccaccaccatgcccagctaatttttgtatttttagtagagatggggtttcatcatgtttgccagactggtctccaactcctgacctcagatggtccacccacctcggcatcctaaagtgctgagatgacaggcatgagccacgacgcccagccacaagttctcaattcttaagagacatggcgataattcatgctgaagaggaactctacaaacctgaaagatgcaacagtgcttttaccaccacctccaacttttgtatacataaaaataaattatactaatgtgaaaccctggaaatgtatgaaatgagacaaagcgtttatatggttgccacacttgattgtagatggagtctcggtctttcacccaggctggagtgctgtggcacgatctcggctcactgcaacctccacctcccaggttcacaccattctcctgcctcagcttcctgagtagctgggactacaggcacccgccaccatgcccggctaatttttttgtatttttagtagagatggggtttcactgtgttagccgggatggtcaatctcctgaccttgtgatccgcccacctcggcctcccaaagtgctgggattacaggcgtgagccaccgcacctggccattatgccactaactttaacctatcccaccttaatcaagggtgtacttaaaagatggtaacaatatactgtttggtacgtagtggaataacatctctacttgtcactttgccagtggctttaaactgcaaatgagttgaattgttcccatagcttaaattttttttcttattgaaatctattactagtatttgtgggtatacagtatgtgtatatctttatgccttatatggcatattttgattcaggcctacaatatgtagtaattacattagggtaaagtatccatcacctctagcatttatcctttgaattacagtgtaattatacatttttaattattttaaaatgtacaattaaattgttactgactacaggtttatttttatggtcataataaaaattatacagaaaaataaataaaatatggccaggtgcagtggctcaggcctgtaatcccagcactttccaaggcaggtggattgtctgaggtcaggagttcaagaccatcctggccaacatagtgaaaccccgtctgaggaagcgctcctttcgcgggggcactcgctgtggatgaataaagtacactgacacacattctgctctgccagtccagctgagggtccgagccgcttacaggctccaaggccaggcacggtggctcatgcctataattccagcactttggagggccaaggcaggcggatcatctgaggtcaggagttcacgcaaatcagggggcccgtgaaaggcaactgagcagggatccatgggaaagacaccctcagaggcacaagattctctcgttacctttcagtttgctgatacttcagttaaagtctcctgggaaacgtctgcattaggttcttcctctgtagttcttcttaccttgcctgtaaaacaaaacctatctagtgtctgcataggtttccacttcttgtccccacctgaggaatggaaagcaacggcacagtccttgctcatgttttggagtgaaaggagcttgaaggtcatgtgagctttgccaaggcttctcctggcctcatgtcagatacagctcctaactcccaagcagcctaccatagtgtcctcctttttttgcgtgtgtgatggggtttcgcacttgttgcccaggctggagtgcaatggtacaatctcggctcactgcaacctccgcctcccaggttcaagtgattcttctgcctcagcctctcaagtaactgggattacaggcatgcgccactaagggaggagaccactcctcatattgtcttatgcccaatttctgcttccaaagaaagaagaagtaaaaactaaaaggcagaaatgaaatccacaggcagacagcccagcgccacaccatgggcctggtagttaaagatcgagccctgacctaatcggttatgttatctacagattacagacattgtatagaaaagcactttgaaaatccctgtcctgttctgttccattctaattactggtgcatgcagccttcagtcacttactccctgcttgctcaatcgatcacgaccctctcatgcaaacccccttagagttgtaagcccttaagagggataggaattgctcactcagggagctcagtttttgagacgtgagtcttgccaatgctcccggccgaataaagcccttccttctttaa

SEQ ID NO: 202733 - DNA, 571 bp, Homo sapiens
  Payload ID: 19983
  Gene Name: zinc finger protein 506
  ENST ID: ENST00000590319
  CDS Start-End: 126-571
agctatcgtcttcactgctctgtgccgtcagctcctagaggcccagcctctgtggccctgtgacctgcaggtattaggagggtcacagctaggacgccgggaccccctggaagcctagaaatgttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaactacccagagaaaaatatttcaatgtgatgaatatgtgaaattcttgcataaattttcaaattcaaacaaacataagataagagatactggaaaaaaatcttttaaatgtatagaatatgggaaaacttttaaccagtcttcaacccgtactacatataagaaaattgatgctggagagaaacgctataaatgtgaagaatgtggtaaagcctataagcagtcctcacaccttactacacataagaaaattcatactgg

SEQ ID NO: 202734 - DNA, 831 bp, Homo sapiens
  Payload ID: 19983
  Gene Name: zinc finger protein 506
  ENST ID: ENST00000587461
  CDS Start-End: 138-464
gctgacgccagagatccagctatcgtcttcactgctctgtgccgtcagctcctagaggcccagcctctgtggccctgtgacctgcaggtattaggagggtcacagctaggacgccgggaccccctggaagcctagaaatgggaccattgcaatttagagatgtggccatagaattctctctggaggagtggcattgcctggacgctgcacagcggaatctatatagggatgtgatgttagagaactacagaaacctgatcttccttggtattgttgtctctaaaccaaacctgatcacctgtctggagcaaggaaaaaaacctttaactatgaagaggcatgagatgattgccaaacccccaggccaggcacggtggctcatgcctataattccagcactttggagggccaaggcaggcggatcatctgaggtcaggagttcacgcaaatcagggggcccgtgaaaggcaactgagcagggatccatgggaaagacaccctcagaggcacaagattctctcgttacctttcagtttgctgatacttcagttaaagtctcctgggaaacgtctgcattaggttcttcctctgtagttcttcttaccttgcctgtaaaacaaaacctatctagtgtctgcataggtttccacttcttgtccccacctgaggaatggaaagcaacggcacagtccttgctcatgttttggagtgaaaggagcttgaaggtcatgtgagctttgccaaggcttctcctggcctcatgtcagatacagctcctaactcccaagcagcctaccatagtgtcctcctttttttgcgtgtgtgatgggg

SEQ ID NO: 202735 - DNA, 7638 bp, Homo sapiens
  Payload ID: 19984
  Gene Name: zinc finger protein 507
  Uniprot ID: Q8TCN5
  ENST ID: ENST00000311921
  CDS Start-End: 193-3054
gacccacccgcggctcacgtgatccgtccccagcgccgccattttggagctccggatgaggagggggaaaccgggggaaaagagggaaaagagccgggagagaggtgggcaaggacgagggcgagggcacggccgggtcctggctggccaaacgaggctcgcggaagcagcagccgccgcctgaccgcagatatggaagaaagtagcagtgttgccatgttggtgccagatattggggaacaggaagctatactgactgctgaaagtatcatcagtccttcattggaaattgatgaacaaagaaaaactaaaccagatccattaatccatgttatccagaagttaagcaagatagtggaaaatgaaaagtcacaaaaatgtcttttaattgggaagaaacgcccacgttcaagtgctgcaacacactctcttgaaacccaagaactttgtgagattccggctaaagtaatccagtcacctgctgctgatactagaagggctgagatgtcacaaacaaattttacccctgacactcttgcccagaatgaagggaaggctatgtcttatcagtgtagcctttgtaagtttctatcatcatccttttccgtgttaaaagatcatattaagcaacatggtcagcaaaatgaagtgatactgatgtgctcagagtgccatattacatctagaagccaggaggaacttgaagcccacgtggtgaatgaccatgacaatgatgccaatatccacacccaatccaaagcccaacagtgcgtaagcccctccagctctttgtgtcggaaaaccacagaaagaaatgaaaccattccagatatcccagtaagtgtggacaatctacagactcatactgtccaaactgcatctgtggcagaaatgggtaggaggaaatggtatgcatacgaacagtacggcatgtatcgatgcttgttttgtagttatacttgtggccagcagagaatgttgaaaacacacgcttggaaacatgctggggaggttgattgctcctatccaatctttgaaaatgaaaatgaacccctaggcctgctggattcttcagcagctgctgcgcctggtggggtcgatgcagtcgtcattgctattggagagagtgaactgagtatccacaatgggccatcagtgcaagtgcagatttgcagctcagaacagttatcatcttcatctcctttagaacagagtgcagaaagaggagtacacctaagtcagtcagttaccctggaccccaatgaggaagaaatgctagaagtgatttctgatgcagaggagaatctgattcctgatagcctgcttacatcagcacagaaaatcatcagcagcagccccaataaaaaagggcatgttaacgtgatagtggagcgattgccaagtgctgaagaaaccctttcacagaagcgcttcctcatgaacactgaaatggaagaagggaaggacctgagcctgacagaagctcagattgggcgcgaaggaatggatgatgtttatcgtgctgataaatgtactgttgatattgggggattgatcataggctggagcagttcagagaaaaaagacgagttaatgaataaaggcctggctactgatgagaatgccccaccaggccggagaaggacaaattctgagtctcttcgattacactcattagctgcagaagcccttgtcacaatgcctataagagctgcagagttgacaagagccaacctggggcactatggagatataaaccttttagatccagatactagtcaaaggcaagtagatagtacattggcagcgtactcaaaaatgatgtcgccacttaaaaactcttcagatggattaactagtcttaaccaaagcaactccaccttggtagcactcccagagggtaggcaggaattgtcagatgggcaggttaagacaggcatcagcatgtccttactcaccgtcattgaaaaattgagagaaaggacagaccaaaacgcttcagacgatgacattttgaaagagttgcaggacaacgcccagtgccaacccaacagcgatacaagtttgtccggaaacaatgtggtggaatacatcccgaatgctgaacgaccctaccgttgccgcctgtgtcactacacaagtggcaacaagggctacatcaagcagcacttacgagtccatcgacagagacagccttatcagtgtcctatctgcgagcacatagcggacaacagcaaagatttggagagtcacatgatccaccactgtaagacaagaatataccagtgcaagcagtgtgaagaatccttccattataagagtcaattgaggaaccatgagagagaacagcacagtcttccagataccttgtcaatagcaacttctaatgagccaagaatttccagtgatacagctgatggaaaatgtgtccaggaagggaataagtcttcagtccagaaacaatatagatgtgatgtgtgtgattatacaagtacaacatatgttggtgtcagaaaccacaggcgaatccataactctgataagccgtacagatgctctctgtgtgggtatgtgtgtagccatcctccttctttgaagtctcatatgtggaaacatgcaagtgaccaaaattacaactacgaacaagtaaacaaggctattaacgacgcgatttcacaaagtggcagagttctggggaaatcccctggaaagactcaattaaagagcagtgaagagagtgcagatcccgtcactggaagttcagaaaatgcagtgtcatcttcagaactgatgtcccagactcccagtgaagttctgggtaccaacgagaatgagaaactgagccctacaagtaatacctcatatagtttagaaaaaatctccagtctggcccctcctagcatggagtactgcgttttactcttctgctgttgtatttgtggttttgaatcaaccagcaaagaaaacctcttggatcatatgaaagagcacgagggtgaaattgtaaacatcatcctgaataaggaccacaatacagctctaaacacaaattaggtggaataatgactcgagcaggaaagcagtagaagaggattccttcaccacagtttcacctttacgctgtcagacaacttcctgccacagaagaagtcgttgatgtgatttttgaggaaatgacagatgtgactttggaaccaaacttgtaataaaaggaattccaaatggacaagcagtaatgatatttaaatattttgagtgagggggagtgggtcaaagaggaagtagaggtgtaatcctgtattaaccctctgtcaccccttcttagtgtcgagtgtatttattaataaaagcttattagagtgtagaaatgccagcaagagttaagaaagggcttttcaggaactattctaaaagtcataaaagggtcacagtcttaagcagagcttagttttcttctcacttgtcaaatgcagactgtgaggcctccagtgagaaatgggaggcagttctgggagggggttttttcagtgtcaccaacagagtcaacaaggaaacataattagagggctttgaaatgatctactgaaatacctaaattgatagaaattaatcatactcaatctaggacatgttcctttactccttaaaaaagaaaggaaagatctctaaattcaaagctagattgtaaataggcattcaagaagtattgtcttaaatttacgatgaatttcttgtgagcagaggacgaaacaggtgaattctcaccagactcaaaccagatctcaattcgtagtaatgctaaatcgtcttccgtgttctcagaggttcttttcagtgtctgtcagaacttggcatactttctccatagtacgtagaccttctaatactctgctaaatgaaaccacacttgttatctgaaagtgtgtgaaagaaacaatgtatgaaaatttacatttgatcatccggcattggaaatagtttgaactatttccaaaaatcccttaggggatgaggggtgaaatttaaaagctcctgaaaatgagtactgctgtgttgagcttttctttcctggggtatattaatttagttatatttagcagaagaggaatataaccaaatgtgactaaaatatagcagaaattcaggttgtttgtaaaaattttaataacaaatagcatttggcaagtctataggattcttcctatctggaaattctattttgttagagtgcgataggacatatggaaaaccaacacaaagtgctttagcattaaaactcaccatcaaatagatgtaatcttattaattacacattttgtattttaattatttcaaggagtgaagaaaacagggtgtttttgtttttgtagttctgattactcatttatgcattgttttgtttaagtaaattctgcctacaagtgaaaaggtcggtgcgctcttctgtgcaccatcctcacggtgctatttccgaatatctgaatattgatttctaacacctggatgaggctgtgaccgatcaacttggaacactgtaaaggttttcgaatgggatacgctgtaggcacgttttaagaagtattctgttcctaaagtccaggtatgattggattaatatttataaaattattattaggaattatttaagtggggccaggcatcttgcaacattttctgatttttttttctttctttctaatctcattttggtgatatttaaacaaacataaatgattgtaactttgcagcttttttatttaggtagctttaatttatttatgaaagttaatccatttctgatacgtggtttttaaaaatatgaaatggatttatatatactatattcctcaaatccactgtatgtggacttatattcattttctccttttttcggaattgaaacattttaatttcaaattcaaatagaacatttaaaatgatttcattattattacccatactgttgccactcatattgtaagtcagttttttcattgctggtacaatgactcagtatttctttataaaaatctgttgttctgaaaatcaacaaccttagaaggattttgtcttagaaaatttccttggctttagttttatatcatatttagaaaataataatgaaaagcatccccaaaatttcaatgatgtgaatttttaaattacctttatttctttaaactaattccattgattgttacttaaattttccacctggaatcatggatttaaaatttccccacctcatggggaaaaaactaacccagaagttcaaagcctttaaagtttcatctgattctggccttagaattgtccttaaaagctttctcctggccgataggaggaagcatatatcaaggaggttctttcccttcccattatcattttgtggcaagccttaagttaacaatgtgtctaccaagaacaattgagttttctaaaagtaataatgaagattatgcaattctaactgtagaagagatagctattaaaataatcagtagcctgggcatagtggctcacacctgtaatcccaatactttagaaggccaaggctggaggactgcttgagtccagaagtttaagaccagcctgggcaacacggggagaccctgtctctacaagaaattaaaaattagccaggcatagttggcacgtgcctgtagcaccagctacttgggaggttaaggtgggaggatcacttgagcctgggagatagaggcttgcagtgagccgtgatggcaccattgcactccaaccggggtgacagatgaggtcctctgtttacctccccccccaaaaaaaaaattcagtaggaattccttcatagaataacatgttatttattggtattgacttcttattagacagagctcatagtatttgttttctgctccgaacacttaaaaaatactaagacgtgatagtgaaaatagctttgaaaagaaactacatatggcaaaggtggggaggggggaagatgatgcattctgatcattataaagaatacttttcagggctctatcattttctccctttctctaatcatccagaatatggcgggtgtcccagtgttcaacagtatcatgctaatattccatttgatcggtagtccaagttctttggccagatagtgcaatgttgtgacaccgaccgaagcctttgttctggatctttcttcctattgaaggtggctgctggtggcttcataattttctgttttttttctcacaaagtaaatggtgggcatccatgtttacattgcaccttcccgtgctgtaattggcttgacaaagacaagcaggcttctctgttgagacttattgtgtttttagttttcatagacacttatttaatctttttaaattgtacagcaaggtgctctaagtaatattcgataaaatatatttaatagaaatttgcgtttgatattcatgaacatgaatacatgtatttttttaagaaataagtattgtgtaacactatggcattgcttctatagccaaagtataaaaatttctggaatactgacatgtaaagactacagttaattctgacactgtatcttattaaaataggatgatttgcattttgtaaaattatcctgcacatcaagctgcatgccttaaagcggaaactctaggactgtgttcatgggagagcagttcatctgttcagaacagtgaggcaaggtctgtagtgcttctttaactacctttggaaatactgtacaatgttagaataatttattttgctttacaggagtttgtcatgtattgactttaatattgtattttggtaataaattttttgttaaaaaaaacttggctccaagttctattaaccacaggttgtgttcattcttttcctggaaatgatgactttattgcttagaaagttgtaaataattaaaagcttcccaagagttaaatgaaggttatgatgactcttgataacttgttaatctgttgctgactagcattagactgttacacgaagataaactgaataagcatttagctttttaaatcattttaaaaattaagtctaattttgaagcttttttccttgctacccagttcagtttctcttccaaatgtgacacgcttatatgctttcaattctgatatagtcaaagtgctaaagactagttctgctattgacgaaggaattagcattccttagtgaaggccaaaaactacagtgatatgttcacaccttgatcactctgtcgtctatacagacagctattgacatatttgttgcattgacgaagctaacatcatctgactgtatcgtgggtctggttatccatttgtgccctagaatcctgggtcacctcagttgaaagtgaccaaggccaaatatttcgtcccatgcttcccagggacaacataatcatatcccctgtctttgaaaaacccaatctgaaactgtgtcactaacctccaaattaaagaatccgagcatggaagctctagaacgtatggtccagtgtggcagccactataatatctaagtgtaaaatacatagcagttgcaaagacttagtacaaaaagaatggaaatgtattaacagttttttatattgattacatgttgaaatgatattttggtttaaataaaatattaaaatta

SEQ ID NO: 202736 - DNA, 3194 bp, Homo sapiens
  Payload ID: 19984
  Gene Name: zinc finger protein 507
  Uniprot ID: Q8TCN5
  ENST ID: ENST00000355898
  CDS Start-End: 162-3023
ggcacggccgggtcctggctggccaaacgaggctcgcggaagcagcagccgccgcctgaccgcagctggattttgaagattgatccaagggactgtattaatttcaggaattgatttgaaagacactggctctgccacttaacagccatgtaaccttggatatggaagaaagtagcagtgttgccatgttggtgccagatattggggaacaggaagctatactgactgctgaaagtatcatcagtccttcattggaaattgatgaacaaagaaaaactaaaccagatccattaatccatgttatccagaagttaagcaagatagtggaaaatgaaaagtcacaaaaatgtcttttaattgggaagaaacgcccacgttcaagtgctgcaacacactctcttgaaacccaagaactttgtgagattccggctaaagtaatccagtcacctgctgctgatactagaagggctgagatgtcacaaacaaattttacccctgacactcttgcccagaatgaagggaaggctatgtcttatcagtgtagcctttgtaagtttctatcatcatccttttccgtgttaaaagatcatattaagcaacatggtcagcaaaatgaagtgatactgatgtgctcagagtgccatattacatctagaagccaggaggaacttgaagcccacgtggtgaatgaccatgacaatgatgccaatatccacacccaatccaaagcccaacagtgcgtaagcccctccagctctttgtgtcggaaaaccacagaaagaaatgaaaccattccagatatcccagtaagtgtggacaatctacagactcatactgtccaaactgcatctgtggcagaaatgggtaggaggaaatggtatgcatacgaacagtacggcatgtatcgatgcttgttttgtagttatacttgtggccagcagagaatgttgaaaacacacgcttggaaacatgctggggaggttgattgctcctatccaatctttgaaaatgaaaatgaacccctaggcctgctggattcttcagcagctgctgcgcctggtggggtcgatgcagtcgtcattgctattggagagagtgaactgagtatccacaatgggccatcagtgcaagtgcagatttgcagctcagaacagttatcatcttcatctcctttagaacagagtgcagaaagaggagtacacctaagtcagtcagttaccctggaccccaatgaggaagaaatgctagaagtgatttctgatgcagaggagaatctgattcctgatagcctgcttacatcagcacagaaaatcatcagcagcagccccaataaaaaagggcatgttaacgtgatagtggagcgattgccaagtgctgaagaaaccctttcacagaagcgcttcctcatgaacactgaaatggaagaagggaaggacctgagcctgacagaagctcagattgggcgcgaaggaatggatgatgtttatcgtgctgataaatgtactgttgatattgggggattgatcataggctggagcagttcagagaaaaaagacgagttaatgaataaaggcctggctactgatgagaatgccccaccaggccggagaaggacaaattctgagtctcttcgattacactcattagctgcagaagcccttgtcacaatgcctataagagctgcagagttgacaagagccaacctggggcactatggagatataaaccttttagatccagatactagtcaaaggcaagtagatagtacattggcagcgtactcaaaaatgatgtcgccacttaaaaactcttcagatggattaactagtcttaaccaaagcaactccaccttggtagcactcccagagggtaggcaggaattgtcagatgggcaggttaagacaggcatcagcatgtccttactcaccgtcattgaaaaattgagagaaaggacagaccaaaacgcttcagacgatgacattttgaaagagttgcaggacaacgcccagtgccaacccaacagcgatacaagtttgtccggaaacaatgtggtggaatacatcccgaatgctgaacgaccctaccgttgccgcctgtgtcactacacaagtggcaacaagggctacatcaagcagcacttacgagtccatcgacagagacagccttatcagtgtcctatctgcgagcacatagcggacaacagcaaagatttggagagtcacatgatccaccactgtaagacaagaatataccagtgcaagcagtgtgaagaatccttccattataagagtcaattgaggaaccatgagagagaacagcacagtcttccagataccttgtcaatagcaacttctaatgagccaagaatttccagtgatacagctgatggaaaatgtgtccaggaagggaataagtcttcagtccagaaacaatatagatgtgatgtgtgtgattatacaagtacaacatatgttggtgtcagaaaccacaggcgaatccataactctgataagccgtacagatgctctctgtgtgggtatgtgtgtagccatcctccttctttgaagtctcatatgtggaaacatgcaagtgaccaaaattacaactacgaacaagtaaacaaggctattaacgacgcgatttcacaaagtggcagagttctggggaaatcccctggaaagactcaattaaagagcagtgaagagagtgcagatcccgtcactggaagttcagaaaatgcagtgtcatcttcagaactgatgtcccagactcccagtgaagttctgggtaccaacgagaatgagaaactgagccctacaagtaatacctcatatagtttagaaaaaatctccagtctggcccctcctagcatggagtactgcgttttactcttctgctgttgtatttgtggttttgaatcaaccagcaaagaaaacctcttggatcatatgaaagagcacgagggtgaaattgtaaacatcatcctgaataaggaccacaatacagctctaaacacaaattaggtggaataatgactcgagcaggaaagcagtagaagaggattccttcaccacagtttcacctttacgctgtcagacaacttcctgccacagaagaagtcgttgatgtgatttttgaggaaatgacagatgtgactttggaaccaaacttgtaataaaaggaattccaaatgg

SEQ ID NO: 202737 - DNA, 5764 bp, Homo sapiens
  Payload ID: 19984
  Gene Name: zinc finger protein 507
  ENST ID: ENST00000544431
  CDS Start-End: 209-3082
aaagagggaaaagagccgggagagaggtgggcaaggacgagggcgagggcacggccgggtcctggctggccaaacgaggctcgcggaagcagcagccgccgcctgaccgcagctggattttgaagattgatccaagggactgtattaatttcaggaattgatttgaaagacactggctctgccacttaacagccatgtaaccttggatatggaagaaagtagcagtgttgccatgttggtgccagatattggggaacaggaagctatactgactgctgaaagtatcatcagtccttcattggaaattgatgaacaaagaaaaactaaaccagatccattaatccatgttatccagaagttaagcaagatagtggaaaatgaaaagtcacaaaaatgtcttttaattgggaagaaacgcccacgttcaagtgctgcaacacactctcttgaaacccaagaactttgtgagattccggctaaagtaatccagtcacctgctgctgatactagaagggctgagatgtcacaaacaaattttacccctgacactcttgcccagaatgaagggaaggctatgtcttatcagtgtagcctttgtaagtttctatcatcatccttttccgtgttaaaagatcatattaagcaacatggtcagcaaaatgaagtgatactgatgtgctcagagtgccatattacatctagaagccaggaggaacttgaagcccacgtggtgaatgaccatgacaatgatgccaatatccacacccaatccaaagcccaacagtgcgtaagcccctccagctctttgtgtcggaaaaccacagaaagaaatgaaaccattccagatatcccagtaagtgtggacaatctacagactcatactgtccaaactgcatctgtggcagaaatgggtaggaggaaatggtatgcatacgaacagtacggcatgtatcgatgcttgttttgtagttatacttgtggccagcagagaatgttgaaaacacacgcttggaaacatgctggggaggttgattgctcctatccaatctttgaaaatgaaaatgaacccctaggcctgctggattcttcagcagctgctgcgcctggtggggtcgatgcagtcgtcattgctattggagagagtgaactgagtatccacaatgggccatcagtgcaagtgcagatttgcagctcagaacagttatcatcttcatctcctttagaacagagtgcagaaagaggagtacacctaagtcagtcagttaccctggaccccaatgaggaagaaatgctagaagtgatttctgatgcagaggagaatctgattcctgatagcctgcttacatcagcacagaaaatcatcagcagcagccccaataaaaaagggcatgttaacgtgatagtggagcgattgccaagtgctgaagaaaccctttcacagaagcgcttcctcatgaacactgaaatggaagaagggaaggacctgagcctgacagaagctcagattgggcgcgaaggaatggatgatgtttatcgtgctgataaatgtactgttgatattgggggattgatcataggctggagcagttcagagaaaaaagacgagttaatgaataaaggcctggctactgatgagaatgccccaccaggccggagaaggacaaattctgagtctcttcgattacactcattagctgcagaagcccttgtcacaatgcctataagagctgcagagttgacaagagccaacctggggcactatggagatataaaccttttagatccagatactagtcaaaggcaagtagatagtacattggcagcgtactcaaaaatgatgtcgccacttaaaaactcttcagatggattaactagtcttaaccaaagcaactccaccttggtagcactcccagagggtaggcaggaattgtcagatgggcaggttaagacaggcatcagcatgtccttactcaccgtcattgaaaaattgagagaaaggacagaccaaaacgcttcagacgatgacattttgaaagagttgcaggacaacgcccagtgccaacccaacagcgatacaagtttgtccggaaacaatgtggtggaatacatcccgaatgctgaacgaccctaccgttgccgcctgtgtcactacacaagtggcaacaagggctacatcaagcagcacttacgagtccatcgacagagacagccttatcagtgtcctatctgcgagcacatagcggacaacagcaaagatttggagagtcacatgatccaccactgtaagacaagaatataccagtgcaagcagtgtgaagaatccttccattataagagtcaattgaggaaccatgagagagaacagcacagtcttccagataccttgtcaatagcaacttctaatgagccaagaatttccagtgatacagctgatggaaaatgtgtccaggaagggaataagtcttcagtccagaaacaatatagatgtgatgtgtgtgattatacaagtacaacatatgttggtgtcagaaaccacaggcgaatccataactctgataagccgtacaggaaagagttcagatgctctctgtgtgggtatgtgtgtagccatcctccttctttgaagtctcatatgtggaaacatgcaagtgaccaaaattacaactacgaacaagtaaacaaggctattaacgacgcgatttcacaaagtggcagagttctggggaaatcccctggaaagactcaattaaagagcagtgaagagagtgcagatcccgtcactggaagttcagaaaatgcagtgtcatcttcagaactgatgtcccagactcccagtgaagttctgggtaccaacgagaatgagaaactgagccctacaagtaatacctcatatagtttagaaaaaatctccagtctggcccctcctagcatggagtactgcgttttactcttctgctgttgtatttgtggttttgaatcaaccagcaaagaaaacctcttggatcatatgaaagagcacgagggtgaaattgtaaacatcatcctgaataaggaccacaatacagctctaaacacaaattaggtggaataatgactcgagcaggaaagcagtagaagaggattccttcaccacagtttcacctttacgctgtcagacaacttcctgccacagaagaagtcgttgatgtgatttttgaggaaatgacagatgtgactttggaaccaaacttgtaataaaaggaattccaaatggacaagcagtaatgatatttaaatattttgagtgagggggagtgggtcaaagaggaagtagaggtgtaatcctgtattaaccctctgtcaccccttcttagtgtcgagtgtatttattaataaaagcttattagagtgtagaaatgccagcaagagttaagaaagggcttttcaggaactattctaaaagtcataaaagggtcacagtcttaagcagagcttagttttcttctcacttgtcaaatgcagactgtgaggcctccagtgagaaatgggaggcagttctgggagggggttttttcagtgtcaccaacagagtcaacaaggaaacataattagagggctttgaaatgatctactgaaatacctaaattgatagaaattaatcatactcaatctaggacatgttcctttactccttaaaaaagaaaggaaagatctctaaattcaaagctagattgtaaataggcattcaagaagtattgtcttaaatttacgatgaatttcttgtgagcagaggacgaaacaggtgaattctcaccagactcaaaccagatctcaattcgtagtaatgctaaatcgtcttccgtgttctcagaggttcttttcagtgtctgtcagaacttggcatactttctccatagtacgtagaccttctaatactctgctaaatgaaaccacacttgttatctgaaagtgtgtgaaagaaacaatgtatgaaaatttacatttgatcatccggcattggaaatagtttgaactatttccaaaaatcccttaggggatgaggggtgaaatttaaaagctcctgaaaatgagtactgctgtgttgagcttttctttcctggggtatattaatttagttatatttagcagaagaggaatataaccaaatgtgactaaaatatagcagaaattcaggttgtttgtaaaaattttaataacaaatagcatttggcaagtctataggattcttcctatctggaaattctattttgttagagtgcgataggacatatggaaaaccaacacaaagtgctttagcattaaaactcaccatcaaatagatgtaatcttattaattacacattttgtattttaattatttcaaggagtgaagaaaacagggtgtttttgtttttgtagttctgattactcatttatgcattgttttgtttaagtaaattctgcctacaagtgaaaaggtcggtgcgctcttctgtgcaccatcctcacggtgctatttccgaatatctgaatattgatttctaacacctggatgaggctgtgaccgatcaacttggaacactgtaaaggttttcgaatgggatacgctgtaggcacgttttaagaagtattctgttcctaaagtccaggtatgattggattaatatttataaaattattattaggaattatttaagtggggccaggcatcttgcaacattttctgatttttttttctttctttctaatctcattttggtgatatttaaacaaacataaatgattgtaactttgcagcttttttatttaggtagctttaatttatttatgaaagttaatccatttctgatacgtggtttttaaaaatatgaaatggatttatatatactatattcctcaaatccactgtatgtggacttatattcattttctccttttttcggaattgaaacattttaatttcaaattcaaatagaacatttaaaatgatttcattattattacccatactgttgccactcatattgtaagtcagttttttcattgctggtacaatgactcagtatttctttataaaaatctgttgttctgaaaatcaacaaccttagaaggattttgtcttagaaaatttccttggctttagttttatatcatatttagaaaataataatgaaaagcatccccaaaatttcaatgatgtgaatttttaaattacctttatttctttaaactaattccattgattgttacttaaattttccacctggaatcatggatttaaaatttccccacctcatggggaaaaaactaacccagaagttcaaagcctttaaagtttcatctgattctggccttagaattgtccttaaaagctttctcctggccgataggaggaagcatatatcaaggaggttctttcccttcccattatcattttgtggcaagccttaagttaacaatgtgtctaccaagaacaattgagttttctaaaagtaataatgaagattatgcaattctaactgtagaagagatagctattaaaataatcagtagcctgggcatagtggctcacacctgtaatcccaatactttagaaggccaaggctggaggactgcttgagtccagaagtttaagaccagcctgggcaacacggggagaccctgtctctacaagaaattaaaaattagccaggcatagttggcacgtgcctgtagcaccagctacttgggaggttaaggtgggaggatcacttgagcctgggagatagaggcttgcagtgagccg

SEQ ID NO: 202738 - DNA, 5154 bp, Homo sapiens
  Payload ID: 19985
  Gene Name: zinc finger protein 510
  Uniprot ID: Q9Y2H8
  ENST ID: ENST00000223428
  CDS Start-End: 190-2241
gttcgcagctcaggaaggagggagccccaggaacaggagtcccaccgaagaactgctctctgacagaacagagacctcctcaccagggcttccaaacagatgcagaagaacccagaaaggagcaggtcttgatttgcccaaccagcggcacttcttcatccccttgcccagagagcaccagacttggtgatgtcgccacatccagaagccatcacagattgtgtgacactgaacactgtgggccaacttgcagaaggtggttatcctttacggttctccacactctttcaggagcagcagaaaatgaacatatctcaggcatcagtgtcattcaaggacgtgactatagaattcacccaggaggagtggcagcaaatggcccctgttcagaagaatctgtacagagatgtgatgctggagaactacagcaacctcgtctcagtggggtactgctgtttcaaaccagaggtgatcttcaagttggagcaaggagaggagccttggttctcagaggaggaattctcaaaccagagtcacccaaaagattacagaggtgatgacctgatcaagcagaacaagaaaatcaaagacaaacacttggagcaagcaatatgtatcaataataaaacattgactacagaggaagagaaagttttggggaaaccatttactctgcatgtagctgctgttgcttcaacaaaaatgtcctgcaaatgcaactcatgggaagtgaatttgcaaagtatttctgaatttatcattaataatagaaactattcaacaaagaaaataggttgcggtaatgtatgtgagaattcacctttcaaaattaactttgagaaaactcagactggagagaaattttatgaacataataaaaacatgaaagctctcaattataatgaaaatcttcccaagcatccaaagtttcaaactttggagcaagcttttgaatgtaataaaattggaaaagcctttaatgataaggctaactgtgttaaacataacagttctcacacaggagaaacatcctctaaagatgatgaatttaggaaaaattgtgataagaaaactctctttgaccacaggagaactggcacagggaagaaacacctgcatcttaatcaatgtgggaaatcctttgagaagtcaactgtggaggaatataataaacttaatatgggtataaaacattatgaattaaatccaagtggaaataatttcaacagaaaggcacacctcactgatcctcaaacagctgtcatagaagagaacccattggtaagtaatgacagaacacagacttgggttaaatcctctgaatatcatgaaaataagaaatcctaccagacgtcggttcacagagttcgccgaagaagtcactcaatgatgaaaccctataaatgtaatgaatgtgggaaatccttctgtcagaaaggacatctcattcaacatcagagaactcacacaggagagaaaccatttgaatgtagtgaatgtggaaaaactttctcccagaagtcacacctcagtactcatcagagaattcatacagcagaaaaaccctataaatgtaatgaatgtggaaaaacatttgtccagaagtcaaccctcaggggacatcaaagaattcacacaggagaaaaaccctatgaatgtagtgaatgtgggaaaacttttgttcagaagtccaccctcagagatcatcacagaattcacacaggggagaaatcctttcaatgcaatcaatgtggaaaaacatttggccagaagtcaaacctcagaatacatcagagaactcacactggggagaaaacttaccagtgtaatgaatgtgaaaaatccttctggcgaaaagatcatctcattcaacatcagaaaactcacacgggagagaaaccattcaaatgtaacgaatgtgggaaaacttttgcccggacatcaaccctcagagtgcatcaaagaattcacactggggagaaaccatttaaatgtaatgaatgtgggaagaaatttgtccggaaagcaatccttagtgatcatcagagaattcacacaggggagaaaccctttcagtgtaataaatgtgggaaaacttttggccagaaatcaaacctcagaatacatcaaaggactcacagtggggagaaatcttatgaatgcaatgaatatgggaaattatgtaagaagtctaccctaagcttataccagaaaattcagggagaggggaatccctattgatgtaataactagaaaatccttttgacaaaaggaataccccatttgatatcagagatacacaaaaaaccaattgagggtagtgaatgtaagaagacagtcccagaagtaaaccctcactgtgaatcagagaattcacataggaaagaaaccagatgaagatgaatgcaggaagaattgtgtccaaaatgcaaccttcagagtgtatcaaagaattcagacaggcttctgttttcagagtactatggataggcctgaatgaagtcataccctattagatagctcccacacatcacacaggctggtaatctcttcaccagcaccaatttcattttactccaggcacatagtccagatttcccaatctccttttcatccaggttggtctttgtgactggctactaagatgtggatgtccatgatgtatatcacatcccagtctgaaacataagagacttccctaataaattaccagggccctgtcacaacaaaatggatatcatttctaggacaagcttggtgccgtgctttaatgtggcatggtacaagataaagaagtctgtgcctgaatgaatacacgcagcaaaattctcctcttctgtgtctttcccagttgaacattatgtgagcaaaatttaagcttatacagtagtccccccttatctgtattttcactttacgcaatttccattaaccatggtcaactgtactttaaagttattaaatggatccagaaataaacaattcctacattttaaactgcacccgattctgagtagtgggatgaagtctcatgccctcctgctctcccatgagggttattgaatcattccttagtctagcatatccacagtgtatacactatctgccagttagtcacttacttgacattttagttatcagatcacctgtcagggtatgacagtgcttgtattcaagtaacccttgttttactaaataatggcctgaaattgcaagagcatttctggcatgttgttgtaattattccattattagtccttaatttataaattaggcacagcaagagattaaactatcataggcatgtgtatatgtaggaaaaaaatatagtatatacagggttcagtatacccgtggtttcaaacatcaacttggaattcttggagagcattccttgtagttaagcagggactactgtattctgttgagctttcacatgtttgagtctatttgtttctacacataatttagttatcttctgctaggaaggcagaaagcttctgtgtaagccaggcttaagtcaatcagagggcacaaaccttattaggaggctagagagtcaaggagaacctcaaatatgatcagagaattgtggaaaagacatcctttcaatgtaatgaaattgatagtaccacctgatacagggctttgcatgaacctaaaagtcttttggctgaatggtgagcagccactgtgcagttcaacgtaagtgtgccttaattgcacagaggtactgcccccacacctcctgacacctccatataccccagctatatctgctttaaggagttttccctggctccaaaggccattggcacccacccaagtattatgggaaacctccagagaggggagggactcagatttatatggctttattgaatccatgcccaaggcaacatcttactagttcctgtgggggtacaggacacctagatttagctaatggggtttggcaatgggaaggcaaacaaatttaataactttatgggtgaggtactttgggccagtagagtatactacagttatgtttacatctgaaagtgtagtagggattaattcccataagttatagagagaattctaattccctgtaattcgcataagtcatagaattctaatcaggaataattgtatgtaaagatacctctgaggtccaacagctctgatcattttgggcttcaagtctctctctgtgactggtgattttgtgggttgaaacttctggcaaaagggggcagcccttgggagctgggggccaggggattgacttggttccctgacaagggtaccaggtccaccccttctgaaaagcagctgttagtttactcttgggctcttttacacattggatatctcttccttgggtagagggttctgacctaaaattccactttaggagtttgtcgtcttggactcaacaactaacaaaatgaaaaggacccagcaagcctcacttgtggaatgaaaatggggcattcaggaaagcacctgtcctggccccacagtatgtcagctgtataggcaatagtagtagctgtctcttagaagggaaataatgtatcacctctttccagaacgaagcaaagttgctggcttagtagagccctcaattcatagaggttactgtaattgggcctggctcactgatgctttcgccaactgaaactactaggatcctgtgtgtgttcaaactcagtgccattaacaaacccaaagtgaagcggtcactcctctcagtggaaagagcacgaggatgttctcagctctggccaatactccatttcataaaccatgttacatttttgttaagccttggctctggatgtggcctagatatttgatattctaattggaaattacagattaaaaagcaccctttctttgtacagtgggggtaaaagtcacagctgcttagtacaaccatctgggttgctcaagtagatgcccataataagagactattttctgataagactgactggaatcaagctgccgacagctttctccatccagattgtgacggttgctacctggatccatcattttactggtatggcaaaaaatcacccatgtgacactgggtgacatggtaaaagtacatggtacttttacagtaccatgtactgtacaaaataaaggtctctttatctg

SEQ ID NO: 202739 - DNA, 675 bp, Homo sapiens
  Payload ID: 19985
  Gene Name: zinc finger protein 510
  ENST ID: ENST00000374641
  CDS Start-End: 273-675
acggatatgcgcgttttcgtctgcgcatgtgcagtcaaccccactttccggcttctccctgttagtgtttgctggtgcagagggttcgcagctcaggaaggagggagccccaggaacaggagtcccaccgaagaactgctctctgacagaacagagacctcctcaccagggcttccaaacagatgcagaagaacccagaaaggagcaggtcttgatttgcccaaccagcggcacttcttcatccccttgcccagagagcaccagacttggtgatgtcgccacatccagaagccatcacagattgtgtgacactgaacactgtgggccaacttgcagaaggtggttatcctttacggttctccacactctttcaggagcagcagaaaatgaacatatctcaggcatcagtgtcattcaaggacgtgactatagaattcacccaggaggagtggcagcaaatggcccctgttcagaagaatctgtacagagatgtgatgctggagaactacagcaacctcgtctcagtggggtactgctgtttcaaaccagaggtgatcttcaagttggagcaaggagaggagccttggttctcagaggaggaattctcaaaccagagtcacccaagtgagttactgagcagtagtagacataattctgcaggagtggttagactcc

SEQ ID NO: 202740 - DNA, 5616 bp, Homo sapiens
  Payload ID: 19985
  Gene Name: zinc finger protein 510
  Uniprot ID: Q9Y2H8
  ENST ID: ENST00000375231
  CDS Start-End: 652-2703
ggtgcagagggttcgcagctcaggtgagagcgccgggcctccacgcggattgcggacctgcagggagggatgtgctagtgtccagggggcgggaacgcgacgtcccgggaactcccccaaagcaggccgtcgctccctgtgcctcggccggcccgggacctcagcctgagaagggccggtgggggcgggctccgggggcgttaggtggggctgagtcctagttggaagatgctcggtgcgggccgaggtatgggcgccagaatgcagccaggcgtcggaaaacgcggtgctggcttcaggaggggaatgcgcgtttattgtattgaccatgaacctgccacaaagcgcgtacagcccgtgggtctgcggtgagaggccgagcctaggagctagaaggacctcgtgaattttggctctgtcacttgagcgtttgaaaatgaggatattagtaaaaactgctttgtgtcgttcagaggaaggagggagccccaggaacaggagtcccaccgaagaactgctctctgacagaacagagacctcctcaccagggcttccaaacagatgcagaagaacccagaaaggagcaggtcttgatttgcccaaccagcggcacttcttcatccccttgcccagagagcaccagacttggtgatgtcgccacatccagaagccatcacagattgtgtgacactgaacactgtgggccaacttgcagaaggtggttatcctttacggttctccacactctttcaggagcagcagaaaatgaacatatctcaggcatcagtgtcattcaaggacgtgactatagaattcacccaggaggagtggcagcaaatggcccctgttcagaagaatctgtacagagatgtgatgctggagaactacagcaacctcgtctcagtggggtactgctgtttcaaaccagaggtgatcttcaagttggagcaaggagaggagccttggttctcagaggaggaattctcaaaccagagtcacccaaaagattacagaggtgatgacctgatcaagcagaacaagaaaatcaaagacaaacacttggagcaagcaatatgtatcaataataaaacattgactacagaggaagagaaagttttggggaaaccatttactctgcatgtagctgctgttgcttcaacaaaaatgtcctgcaaatgcaactcatgggaagtgaatttgcaaagtatttctgaatttatcattaataatagaaactattcaacaaagaaaataggttgcggtaatgtatgtgagaattcacctttcaaaattaactttgagaaaactcagactggagagaaattttatgaacataataaaaacatgaaagctctcaattataatgaaaatcttcccaagcatccaaagtttcaaactttggagcaagcttttgaatgtaataaaattggaaaagcctttaatgataaggctaactgtgttaaacataacagttctcacacaggagaaacatcctctaaagatgatgaatttaggaaaaattgtgataagaaaactctctttgaccacaggagaactggcacagggaagaaacacctgcatcttaatcaatgtgggaaatcctttgagaagtcaactgtggaggaatataataaacttaatatgggtataaaacattatgaattaaatccaagtggaaataatttcaacagaaaggcacacctcactgatcctcaaacagctgtcatagaagagaacccattggtaagtaatgacagaacacagacttgggttaaatcctctgaatatcatgaaaataagaaatcctaccagacgtcggttcacagagttcgccgaagaagtcactcaatgatgaaaccctataaatgtaatgaatgtgggaaatccttctgtcagaaaggacatctcattcaacatcagagaactcacacaggagagaaaccatttgaatgtagtgaatgtggaaaaactttctcccagaagtcacacctcagtactcatcagagaattcatacagcagaaaaaccctataaatgtaatgaatgtggaaaaacatttgtccagaagtcaaccctcaggggacatcaaagaattcacacaggagaaaaaccctatgaatgtagtgaatgtgggaaaacttttgttcagaagtccaccctcagagatcatcacagaattcacacaggggagaaatcctttcaatgcaatcaatgtggaaaaacatttggccagaagtcaaacctcagaatacatcagagaactcacactggggagaaaacttaccagtgtaatgaatgtgaaaaatccttctggcgaaaagatcatctcattcaacatcagaaaactcacacgggagagaaaccattcaaatgtaacgaatgtgggaaaacttttgcccggacatcaaccctcagagtgcatcaaagaattcacactggggagaaaccatttaaatgtaatgaatgtgggaagaaatttgtccggaaagcaatccttagtgatcatcagagaattcacacaggggagaaaccctttcagtgtaataaatgtgggaaaacttttggccagaaatcaaacctcagaatacatcaaaggactcacagtggggagaaatcttatgaatgcaatgaatatgggaaattatgtaagaagtctaccctaagcttataccagaaaattcagggagaggggaatccctattgatgtaataactagaaaatccttttgacaaaaggaataccccatttgatatcagagatacacaaaaaaccaattgagggtagtgaatgtaagaagacagtcccagaagtaaaccctcactgtgaatcagagaattcacataggaaagaaaccagatgaagatgaatgcaggaagaattgtgtccaaaatgcaaccttcagagtgtatcaaagaattcagacaggcttctgttttcagagtactatggataggcctgaatgaagtcataccctattagatagctcccacacatcacacaggctggtaatctcttcaccagcaccaatttcattttactccaggcacatagtccagatttcccaatctccttttcatccaggttggtctttgtgactggctactaagatgtggatgtccatgatgtatatcacatcccagtctgaaacataagagacttccctaataaattaccagggccctgtcacaacaaaatggatatcatttctaggacaagcttggtgccgtgctttaatgtggcatggtacaagataaagaagtctgtgcctgaatgaatacacgcagcaaaattctcctcttctgtgtctttcccagttgaacattatgtgagcaaaatttaagcttatacagtagtccccccttatctgtattttcactttacgcaatttccattaaccatggtcaactgtactttaaagttattaaatggatccagaaataaacaattcctacattttaaactgcacccgattctgagtagtgggatgaagtctcatgccctcctgctctcccatgagggttattgaatcattccttagtctagcatatccacagtgtatacactatctgccagttagtcacttacttgacattttagttatcagatcacctgtcagggtatgacagtgcttgtattcaagtaacccttgttttactaaataatggcctgaaattgcaagagcatttctggcatgttgttgtaattattccattattagtccttaatttataaattaggcacagcaagagattaaactatcataggcatgtgtatatgtaggaaaaaaatatagtatatacagggttcagtatacccgtggtttcaaacatcaacttggaattcttggagagcattccttgtagttaagcagggactactgtattctgttgagctttcacatgtttgagtctatttgtttctacacataatttagttatcttctgctaggaaggcagaaagcttctgtgtaagccaggcttaagtcaatcagagggcacaaaccttattaggaggctagagagtcaaggagaacctcaaatatgatcagagaattgtggaaaagacatcctttcaatgtaatgaaattgatagtaccacctgatacagggctttgcatgaacctaaaagtcttttggctgaatggtgagcagccactgtgcagttcaacgtaagtgtgccttaattgcacagaggtactgcccccacacctcctgacacctccatataccccagctatatctgctttaaggagttttccctggctccaaaggccattggcacccacccaagtattatgggaaacctccagagaggggagggactcagatttatatggctttattgaatccatgcccaaggcaacatcttactagttcctgtgggggtacaggacacctagatttagctaatggggtttggcaatgggaaggcaaacaaatttaataactttatgggtgaggtactttgggccagtagagtatactacagttatgtttacatctgaaagtgtagtagggattaattcccataagttatagagagaattctaattccctgtaattcgcataagtcatagaattctaatcaggaataattgtatgtaaagatacctctgaggtccaacagctctgatcattttgggcttcaagtctctctctgtgactggtgattttgtgggttgaaacttctggcaaaagggggcagcccttgggagctgggggccaggggattgacttggttccctgacaagggtaccaggtccaccccttctgaaaagcagctgttagtttactcttgggctcttttacacattggatatctcttccttgggtagagggttctgacctaaaattccactttaggagtttgtcgtcttggactcaacaactaacaaaatgaaaaggacccagcaagcctcacttgtggaatgaaaatggggcattcaggaaagcacctgtcctggccccacagtatgtcagctgtataggcaatagtagtagctgtctcttagaagggaaataatgtatcacctctttccagaacgaagcaaagttgctggcttagtagagccctcaattcatagaggttactgtaattgggcctggctcactgatgctttcgccaactgaaactactaggatcctgtgtgtgttcaaactcagtgccattaacaaacccaaagtgaagcggtcactcctctcagtggaaagagcacgaggatgttctcagctctggccaatactccatttcataaaccatgttacatttttgttaagccttggctctggatgtggcctagatatttgatattctaattggaaattacagattaaaaagcaccctttctttgtacagtgggggtaaaagtcacagctgcttagtacaaccatctgggttgctcaagtagatgcccataataagagactattttctgataagactgactggaatcaagctgccgacagctttctccatccagattgtgacggttgctacctggatccatcattttactggtatggcaaaaaatcacccatgtgacactgggtgacatggtaaaagtacatggtacttttacagtaccatgtactgtacaaaataaaggtctctttatctg

SEQ ID NO: 202741 - DNA, 2004 bp, Homo sapiens
  Payload ID: 19986
  Gene Name: zinc finger protein 511
  Uniprot ID: Q8NB15
  ENST ID: ENST00000359035
  CDS Start-End: 4-792
gtgatgcagttgccccccgcgctgtgcgcccgcctcgctgcggggcccggggcggcggagccgctgcctgtagagcgggatcccgcggctggggccgcgccctttcgcttcgttgcgcgccccgtgcgcttcccgcgggagcaccagttcttcgaggatggggacgtgcagcgccacctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcaggtgagaggcggatctacagacataggtcagtgtctgagctctttctgaaacccgttctcaacatgtgttcggtgctgaggattctgggctgcacctgggccgcagctcttctcatactgaattcagaaaggtaacgctgggtaagaaaatcggcttccgccagagaagaaagtccagatatctcaggtcctgtgaataacttagtttctctcgcatactctgtttttgagccattgaagcgcaggaatgccaagcaccactcacttttcctcattgtctgagtgggatggaaagagtctcacttgcagttgcttcagtcacaacccaggcgtctgccttaatagcatcacctgtgccgtctgcgtttctagcgtcacctgtgccgtctgcgtttctagcgtcacctgtgccgtctgccttcctagcatgacctgtgccgtctgcctttctagcatgacctgtactgtctgcctttctagcgtcacctgtgccgtctgcctttctagttaaagttgattttaaattaatttgggaaaaacggtgaacaagtggggaaaaacatcaccaaagactccaaacaggtggaacgatgaacttaatgttccctgcaccctccttacagatgcctggactttggcctgtgaatgagccccggggggctgggacagtaggggttttcatggaatggacatggggtagcaggaagtctcagccccagagggcttggcaggagccgccctctctgcggagttcttcccagcgggtgtgcgttggtggctggcggggaccccccacaggaactaggtctcaggctgtggaaagggagctgccccagggcccaggagggccggctctgcattccgcatgttcccagagtgaaagagaatgagaaggagacacacaagtgctgttatgacctgggttgttggttggcaaatacagcatctaatagaaactttcttccatcccagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtatttttaaacacatgaaataagtatttttcactgat

SEQ ID NO: 202742 - DNA, 1520 bp, Homo sapiens
  Payload ID: 19986
  Gene Name: zinc finger protein 511
  Uniprot ID: Q8NB15
  ENST ID: ENST00000361518
  CDS Start-End: 470-1228
ccagggactgcagcgggagacgacaggcggggcaaggcggacgggagagggcgtgcgagagggggacctgcgacccggcttcccagggctgggaggggacacccgggacgacccggaggcccgctccgccccgccccggctgagtgtcgggccgcggggcaagacgctggcctggccggtgcaggcccgaagggcttcggccccagagttcggggaccgctgcacagccagagggagcgcgcgggaagagccgcgtcccgccagccccgtcgcctcgtgggcccccccgggcctggcagtcccccaaccccctcatcacgcccgcgcccgcgttcggccaggactcaccgcagtcccggagccacagcccccgcgcagcccccgacggcggcggaagtgagcgtgacgtcacgtccggctcggctcgcggacggtggccgacaggctgcgcccgcccgcgcccggggtgatgcagttgccccccgcgctgtgcgcccgcctcgctgcggggcccggggcggcggagccgctgcctgtagagcgggatcccgcggctggggccgcgccctttcgcttcgttgcgcgccccgtgcgcttcccgcgggagcaccagttcttcgaggatggggacgtgcagcgccacctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcaggtgagaggcggatctacagacatagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtatttttaaacacatgaaataagtatttttcac

SEQ ID NO: 202743 - DNA, 3541 bp, Homo sapiens
  Payload ID: 19987
  Gene Name: zinc finger protein 512
  Uniprot ID: Q96ME7
  ENST ID: ENST00000355467
  CDS Start-End: 84-1787
cccacatccgggagaggagagcggaagtggcgttggtctggccggagcccttgggtgaaattgttaggcgtggagagggagtgatgtcttccagactcggtgctgtacccgccacttcgggacccacaacctttaagcagcagaggagcacgaggatcgtgggagctaagaatagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaagatgtttccagtgttctttgacgccgacctgctgcatgactccttgacactgtatgggggtaagaagatggctagagatgggggtgagtttgaaataaattccacatgcagttgtctcagt

SEQ ID NO: 202744 - DNA, 3417 bp, Homo sapiens
  Payload ID: 19987
  Gene Name: zinc finger protein 512
  ENST ID: ENST00000379717
  CDS Start-End: 84-1784
cccacatccgggagaggagagcggaagtggcgttggtctggccggagcccttgggtgaaattgttaggcgtggagagggagtgatgtcttccagactcggtgctgtacccgccacttcgggacccacaacctttaagcagcagaggagcacgaggatcgtgggagctaagaacaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaa

SEQ ID NO: 202745 - DNA, 3703 bp, Homo sapiens
  Payload ID: 19987
  Gene Name: zinc finger protein 512
  Uniprot ID: Q96ME7
  ENST ID: ENST00000413371
  CDS Start-End: 477-1949
agccccctcggaagctgctaggcggaagtagaagttcagaagagggctaggcggagccgagcccacatccgggagaggagagcggaagtggcgttggtctggccggagcccttgggtgaaattgttaggcgtggagagggagtgatgtcttccagactcggtgctgtacccgccagcctgggacagggctttgagaatgggggaagacgaaggctctggtattgttacccgcctttgcactgctggaagataggacagcatatttttcctaaaagacttcgggacccacaacctttaagcagcagaggagcacgaggatcgtgggagctaagaatagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaagatgtttccagtgttctttgacgccgacctgctgcatgactccttgacactgtatgggggtaagaagatggctagagatgggggtgagtttgaaataaattccacatgcagttgtctcagt

SEQ ID NO: 202746 - DNA, 3515 bp, Homo sapiens
  Payload ID: 19987
  Gene Name: zinc finger protein 512
  Uniprot ID: Q96ME7
  ENST ID: ENST00000416005
  CDS Start-End: 145-1761
agccccctcggaagctgctaggcggaagtagaagttcagaagagggctaggcggagccgagcccacatccgggagaggagagcggaagtggcgttggtctggccggagcccttgggtgaaattgttaggcgtggagagggagtgatgtcttccagactcggtgctgtacccgccacttcgggacccacaacctttaagcagcagaggagcacgaggatcgtgggagctaagaacaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaagatgtttccagtgttctttgacgccgacctgctgcatgactccttgacactgtatgggggtaagaagatggctagagatgggggtgagtttgaaataaattccacatgcagttgtctcagt

SEQ ID NO: 202747 - DNA, 3543 bp, Homo sapiens
  Payload ID: 19987
  Gene Name: zinc finger protein 512
  Uniprot ID: Q96ME7
  ENST ID: ENST00000556601
  CDS Start-End: 317-1789
agccccctcggaagctgctaggcggaagtagaagttcagaagagggctaggcggagccgagcccacatccgggagaggagagcggaagtggcgttggtctggccggagcccttgggtgaaattgttaggcgtggagagggagtgatgtcttccagactcggtgctgtacccgcctagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaagatgtttccagtgttctttgacgccgacctgctgcatgactccttgacactgtatgggggtaagaagatggctagagatgggggtgagtttgaaataaattccacatgcagttgtctcagt

SEQ ID NO: 202748 - DNA, 2974 bp, Homo sapiens
  Payload ID: 19988
  Gene Name: zinc finger protein 512B
  Uniprot ID: Q96KM6
  ENST ID: ENST00000217130
  CDS Start-End: 52-2730
ccgcgcccggcccggcccgggaagggagacgcgacccagcccgacgcagagatgacggatcctttctgcgttggaggccgtcggctcccggggtccagcaagagtggtcccgggaaggatggcagccgaaaggaggtccgacttccaatgctgcatgacccaccgaagatggggatgccggtggtccgtggtggacagacagtgcccggccaggcccctctctgctttgacccgggaagtccagccagtgacaagacagaagggaagaaaaaggggcggccaaaagccgagaaccaggccctccgagacattcctctctccctgatgaacgactggaaggatgagttcaaggcacactcgagggtgaagtgtccaaactcagggtgctggctggagttccccagcatctacgggctcaagtaccattaccagcggtgccaagggggtgccatctcagatcgcctggccttcccctgccccttctgcgaggccgcattcacctctaagacccagctggagaaacaccggatctggaaccacatggaccgacccctgcctgcctccaagcctgggcccatcagcaggccggtcaccatcagccggcctgttggggtcagcaagcccatcggagtgagcaaacctgtcactattggcaaacctgtgggtgtcagcaaacccattggcatcagcaagccagtctcggtcggcagacccatgccagtcaccaaggccatcccggtcactaggcccgtgccagtcaccaaacctgtcacagtcagcaggcccatgcccgtcaccaaggccatgccggtcaccaaacccatcacagtcaccaagtctgtgccggtcaccaaacccgtacctgtcaccaaacccattacggtaacaaagcttgtgacagttacgaaacccgtgccggtcaccaagccagtgacagtcagcaggcccattgtggtcagcaagccggtgacagtcagcaggcccattgctatcagcagacacacaccgccctgcaaaatggtgctgctgaccaggtcggagaacaaagcacctcgtgccacagggaggaacagtggtaagaaaagggctgcggacagcctggacacctgcccaattccacccaagcaggccaggccagagaatggggagtacggcccctcctccatgggccagagctcggccttccagctgagtgcagacaccagcagtggctccttgtcgccaggcagcaggccgtcagggggcatggaggcactgaaggctgcaggccctgcgtccccgcctgaggaggacccggagcgcacaaagcacagaaggaaacagaaaacacccaaaaagtttacaggggagcagccatccatctcagggacctttgggctcaaaggcctggtcaaagctgaggacaaggcccgagttcaccgctccaagaagcaggaggggccaggccctgaggacgcccggaagaaggtgccagctgcccccatcactgtcagcaaggaggcaccggcccctgtggcccacccagctccaggtggccctgaagagcagtggcagagggccatccatgagcgcggggaagccgtctgccccacctgcaacgtggtcacccggaagactctcgtggggcttaagaagcacatggaggtgtgtcagaagcttcaggatgcactcaagtgccagcactgccggaagcagttcaagtccaaagccggcctcaactaccacactatggccgagcacagtgccaagccctctgacgccgaggcctccgaagggggcgagcaggaggagcgcgagaggctgcgcaaggtgctgaagcagatgggacggctgcgctgcccccaggagggttgcggggctgccttctccagcctcatgggctaccagtaccaccagcggcgctgcgggaagccgccctgcgaggtggacagcccctccttcccctgcacccactgtggcaagacgtaccgatccaaggctggccacgactaccacgtgcgctcggagcacacggcccccccccctgaggagcccacagacaagtcccctgaggctgaggacccgctgggtgtggagcggaccccaagcgggcgtgtccgccgcacgtcggcccaggtggcggtgttccacctgcaggagatagcggaggacgagctggcccgcgactggaccaagcggcgcatgaaggatgaccttgtgcccgagaccgcacggctcaactacactcgaccagggctccccacgctgaacccccagctgctagaggcatggaagaatgaagtgaaggagaaaggccacgtcaactgtcccaacgactgctgtgaagccatctactccagcgtgtccggactcaaggctcatctcgccagctgcagtaagggggcccacctggcagggaagtaccgctgtctgctgtgtccgaaggagttcagttctgagagtggcgtcaaataccacatcctgaagacccacgcagagaactggttccgaacatcagcagacccacctcccaaacacaggagccaggactcattggtgcccaagaaggaaaagaagaaaaatctggcaggtggaaagaagcggggccgaaagcccaaggagcggaccccagaggagcctgtggccaagctgcccccgcgccgggacgactggcctccaggatgcagagacaagggggcccggggctccaccggccggaaggtgggagtcagcaaggcgcctgaaaagtgagcatggtgcgtggggcctggcccccatgcagccgccacaccgccctctgttcaaggcagggccagctccgggacctctgtcctccagttctccatcccccacccccgcctcttcatccgtccagtggggcagccagccactctcccttccctgaaggtggcccttcccctgttaaggctgccacagggcacacctgggttggggctccccaaggtgtgcccagcagaagtgcaatagccaggag

SEQ ID NO: 202749 - DNA, 5919 bp, Homo sapiens
  Payload ID: 19988
  Gene Name: zinc finger protein 512B
  Uniprot ID: Q96KM6
  ENST ID: ENST00000369888
  CDS Start-End: 55-2733
ccccccgccccggcccggcccggcccggccgcagccccgctgggcgccgcagagatgacggatcctttctgcgttggaggccgtcggctcccggggtccagcaagagtggtcccgggaaggatggcagccgaaaggaggtccgacttccaatgctgcatgacccaccgaagatggggatgccggtggtccgtggtggacagacagtgcccggccaggcccctctctgctttgacccgggaagtccagccagtgacaagacagaagggaagaaaaaggggcggccaaaagccgagaaccaggccctccgagacattcctctctccctgatgaacgactggaaggatgagttcaaggcacactcgagggtgaagtgtccaaactcagggtgctggctggagttccccagcatctacgggctcaagtaccattaccagcggtgccaagggggtgccatctcagatcgcctggccttcccctgccccttctgcgaggccgcattcacctctaagacccagctggagaaacaccggatctggaaccacatggaccgacccctgcctgcctccaagcctgggcccatcagcaggccggtcaccatcagccggcctgttggggtcagcaagcccatcggagtgagcaaacctgtcactattggcaaacctgtgggtgtcagcaaacccattggcatcagcaagccagtctcggtcggcagacccatgccagtcaccaaggccatcccggtcactaggcccgtgccagtcaccaaacctgtcacagtcagcaggcccatgcccgtcaccaaggccatgccggtcaccaaacccatcacagtcaccaagtctgtgccggtcaccaaacccgtacctgtcaccaaacccattacggtaacaaagcttgtgacagttacgaaacccgtgccggtcaccaagccagtgacagtcagcaggcccattgtggtcagcaagccggtgacagtcagcaggcccattgctatcagcagacacacaccgccctgcaaaatggtgctgctgaccaggtcggagaacaaagcacctcgtgccacagggaggaacagtggtaagaaaagggctgcggacagcctggacacctgcccaattccacccaagcaggccaggccagagaatggggagtacggcccctcctccatgggccagagctcggccttccagctgagtgcagacaccagcagtggctccttgtcgccaggcagcaggccgtcagggggcatggaggcactgaaggctgcaggccctgcgtccccgcctgaggaggacccggagcgcacaaagcacagaaggaaacagaaaacacccaaaaagtttacaggggagcagccatccatctcagggacctttgggctcaaaggcctggtcaaagctgaggacaaggcccgagttcaccgctccaagaagcaggaggggccaggccctgaggacgcccggaagaaggtgccagctgcccccatcactgtcagcaaggaggcaccggcccctgtggcccacccagctccaggtggccctgaagagcagtggcagagggccatccatgagcgcggggaagccgtctgccccacctgcaacgtggtcacccggaagactctcgtggggcttaagaagcacatggaggtgtgtcagaagcttcaggatgcactcaagtgccagcactgccggaagcagttcaagtccaaagccggcctcaactaccacactatggccgagcacagtgccaagccctctgacgccgaggcctccgaagggggcgagcaggaggagcgcgagaggctgcgcaaggtgctgaagcagatgggacggctgcgctgcccccaggagggttgcggggctgccttctccagcctcatgggctaccagtaccaccagcggcgctgcgggaagccgccctgcgaggtggacagcccctccttcccctgcacccactgtggcaagacgtaccgatccaaggctggccacgactaccacgtgcgctcggagcacacggcccccccccctgaggagcccacagacaagtcccctgaggctgaggacccgctgggtgtggagcggaccccaagcgggcgtgtccgccgcacgtcggcccaggtggcggtgttccacctgcaggagatagcggaggacgagctggcccgcgactggaccaagcggcgcatgaaggatgaccttgtgcccgagaccgcacggctcaactacactcgaccagggctccccacgctgaacccccagctgctagaggcatggaagaatgaagtgaaggagaaaggccacgtcaactgtcccaacgactgctgtgaagccatctactccagcgtgtccggactcaaggctcatctcgccagctgcagtaagggggcccacctggcagggaagtaccgctgtctgctgtgtccgaaggagttcagttctgagagtggcgtcaaataccacatcctgaagacccacgcagagaactggttccgaacatcagcagacccacctcccaaacacaggagccaggactcattggtgcccaagaaggaaaagaagaaaaatctggcaggtggaaagaagcggggccgaaagcccaaggagcggaccccagaggagcctgtggccaagctgcccccgcgccgggacgactggcctccaggatgcagagacaagggggcccggggctccaccggccggaaggtgggagtcagcaaggcgcctgaaaagtgagcatggtgcgtggggcctggcccccatgcagccgccacaccgccctctgttcaaggcagggccagctccgggacctctgtcctccagttctccatcccccacccccgcctcttcatccgtccagtggggcagccagccactctcccttccctgaaggtggcccttcccctgttaaggctgccacagggcacacctgggttggggctccccaaggtgtgcccagcagaagtgcaatagccaggagggttgcccctcctcatgggaatgtgtctggggtcttggtgccacaggggctgcagcgcagagtaggcagatggcctttggccccccggctccgcttcctcaggccctgccgggtcccttccctggctaccccaaggctcaggcatccctggtgacctgtggttctgggctggtgagggcacctgagcaacctggcacgggcagccaccatcctggcctcacctccacccaacactggaactccagcacccccagctacctcccaggacagacccctgtctgaccactgccatgctgacctgacaggctccggcctgcccttggccacccacttggtccccttgcttctgttttctacctctccaggcctgcccactacccccacccctgctcctcctttgtcagtgcgatccctgctgtgctcaggccctgccccccaggcctgtctgtaattctcccagcttggggcaagggaggggttttgcttcttgtacctacagggcagcagaagcttgatgcccttcaacacagctgccagccctgggggtgtggggcccctggagtgtgctctcctccagtgttcagccttctggcactgcaggcctaggttggagcagcctcgtggagtagggacggactagttcgggccctggggtcttgctggggcccataggcatgtggggcaggaagctgggcagagctggcctggctctgagtggccactgggggaaaggcagccttctgtctgccaatctgggtaggcccagtggccaagctctcatgggagccccctccccacttttttttttaacctgcccccattgtttctggttgtgtggtcatttgatatgggaactgaaggccagccaggggaggggcttggccaaagtcacagcaggttgatggcagctccagagctgtctttgcccctttgtggccctgaggacggctgggtctataggtagggcaggggtcaggcagggagtccagggtgcctggaagaggtggccacagcctgtggctccctccctggggtcctgccttccaaccacggcattgcagggaggatgaggctcagagggggtaggtttggagggaggccattttccagggtgggtgggagtgggctgagggctcggccccactgaccctggacgatgagaattttgatgtttgcccgtgtgcgtgtgtctcctgggtgtagtggatgccagtcttgttgctgtgacaagtaacaaccttttttttaaattgttttttatacaaacactcgcaatccgacatttggtgctaagggtttcctggtgcagacggtgggcctgggggctgggctggaccagggcgtgggtctctggggttggggtcccttgctgctcagggaggcagtactgactgggcactgcctctgcccccagcacccaccctcccccattccccagggagaaggggccccactgggcttggcctgcagtagtagggagacaagttccaggagcactttggggactggggttgcagaacacttcctgtctctggcttcatccttgggccagaaggctccaaccctcagcagcccttgccagatgtgccagggagtgggtgtggagacccggactccccccacccacgcacacctcggcctgatgagaggatggaggctggggcagagatgggcgtgacccagcgtcagagggtcgggggaggcattccttcctgtgtcccagagcttcactggtggagctggaggagccggaggtggagggtggggtctggcagctgctgctggggcagcctcatgaggggaggggaggggaggggaggggagcaggcactgggcgggggcctaggtgcactttgtccttgccaccaatggcgggaggagggtggacctgaacacctgcagggtgtggtgcctgccccagcctctcaggtacttggcccttggggagaagagaagagggtctggtttttgctgggggtgagtttccgggacactcccaaagcccacagataatccctggtgtgggaagaggagtcctggataccttgatgtttagcactttaaccccctttgtctttaaggtaggcgtgggggctactgccagaagtggctgttgggtctgaccccctcctttctgccctccctctgccacatgctggtccgcagagccctcctcccaaggggtggggccctgggtggagctcagcagggtctgcccactccctacgctggcccacataggcctccaggagccctcagtgagagggaccagcatagctgacccccagagtgtggtgggcgccggccctgcccgaggcccagtcggggccctttctgcagatctacctctggctcagcgcacgccccctgccctgagaacaggaaagggcccggaagggctgactcaccgggccgacgctcacacgaaaatgggatgcactttatttgctggtgcaaaggcaggtgagggtgcctcctgtgtgaccgttggccctcctgcctggtggcgctgaagggaaggagccagtgagcctgaccccgggaggggccgtccccgtgtgccgcgtttggcggggccccaggcggctcccccaggcccgggtctggggccccaggctttcccctgcctcgcggccgggcgtcccgtgctttgggtttcttggtttgggttttttaatgccagttctcagtacataagtgcattttgaaagaggttccagctatcacttgtaaccatatatatatacatatatattctatctacaaagtgtttatttgcgagatgtttcaacggtgagttcgggccccgcccgccttgtgaccatctgtccccggtcctcgtccccgccccgcgccctggtcccgagtggcgtggggacgggccatcactgtatgtattaaaatgactgtatcaaataaatgtttattgatttttttccagg

SEQ ID NO: 202750 - DNA, 5921 bp, Homo sapiens
  Payload ID: 19988
  Gene Name: zinc finger protein 512B
  Uniprot ID: Q96KM6
  ENST ID: ENST00000450537
  CDS Start-End: 60-2738
ccgcggcgtctggctcggctcgcgccttccgcgagctgcccccgctgggcgccgcagagatgacggatcctttctgcgttggaggccgtcggctcccggggtccagcaagagtggtcccgggaaggatggcagccgaaaggaggtccgacttccaatgctgcatgacccaccgaagatggggatgccggtggtccgtggtggacagacagtgcccggccaggcccctctctgctttgacccgggaagtccagccagtgacaagacagaagggaagaaaaaggggcggccaaaagccgagaaccaggccctccgagacattcctctctccctgatgaacgactggaaggatgagttcaaggcacactcgagggtgaagtgtccaaactcagggtgctggctggagttccccagcatctacgggctcaagtaccattaccagcggtgccaagggggtgccatctcagatcgcctggccttcccctgccccttctgcgaggccgcattcacctctaagacccagctggagaaacaccggatctggaaccacatggaccgacccctgcctgcctccaagcctgggcccatcagcaggccggtcaccatcagccggcctgttggggtcagcaagcccatcggagtgagcaaacctgtcactattggcaaacctgtgggtgtcagcaaacccattggcatcagcaagccagtctcggtcggcagacccatgccagtcaccaaggccatcccggtcactaggcccgtgccagtcaccaaacctgtcacagtcagcaggcccatgcccgtcaccaaggccatgccggtcaccaaacccatcacagtcaccaagtctgtgccggtcaccaaacccgtacctgtcaccaaacccattacggtaacaaagcttgtgacagttacgaaacccgtgccggtcaccaagccagtgacagtcagcaggcccattgtggtcagcaagccggtgacagtcagcaggcccattgctatcagcagacacacaccgccctgcaaaatggtgctgctgaccaggtcggagaacaaagcacctcgtgccacagggaggaacagtggtaagaaaagggctgcggacagcctggacacctgcccaattccacccaagcaggccaggccagagaatggggagtacggcccctcctccatgggccagagctcggccttccagctgagtgcagacaccagcagtggctccttgtcgccaggcagcaggccgtcagggggcatggaggcactgaaggctgcaggccctgcgtccccgcctgaggaggacccggagcgcacaaagcacagaaggaaacagaaaacacccaaaaagtttacaggggagcagccatccatctcagggacctttgggctcaaaggcctggtcaaagctgaggacaaggcccgagttcaccgctccaagaagcaggaggggccaggccctgaggacgcccggaagaaggtgccagctgcccccatcactgtcagcaaggaggcaccggcccctgtggcccacccagctccaggtggccctgaagagcagtggcagagggccatccatgagcgcggggaagccgtctgccccacctgcaacgtggtcacccggaagactctcgtggggcttaagaagcacatggaggtgtgtcagaagcttcaggatgcactcaagtgccagcactgccggaagcagttcaagtccaaagccggcctcaactaccacactatggccgagcacagtgccaagccctctgacgccgaggcctccgaagggggcgagcaggaggagcgcgagaggctgcgcaaggtgctgaagcagatgggacggctgcgctgcccccaggagggttgcggggctgccttctccagcctcatgggctaccagtaccaccagcggcgctgcgggaagccgccctgcgaggtggacagcccctccttcccctgcacccactgtggcaagacgtaccgatccaaggctggccacgactaccacgtgcgctcggagcacacggcccccccccctgaggagcccacagacaagtcccctgaggctgaggacccgctgggtgtggagcggaccccaagcgggcgtgtccgccgcacgtcggcccaggtggcggtgttccacctgcaggagatagcggaggacgagctggcccgcgactggaccaagcggcgcatgaaggatgaccttgtgcccgagaccgcacggctcaactacactcgaccagggctccccacgctgaacccccagctgctagaggcatggaagaatgaagtgaaggagaaaggccacgtcaactgtcccaacgactgctgtgaagccatctactccagcgtgtccggactcaaggctcatctcgccagctgcagtaagggggcccacctggcagggaagtaccgctgtctgctgtgtccgaaggagttcagttctgagagtggcgtcaaataccacatcctgaagacccacgcagagaactggttccgaacatcagcagacccacctcccaaacacaggagccaggactcattggtgcccaagaaggaaaagaagaaaaatctggcaggtggaaagaagcggggccgaaagcccaaggagcggaccccagaggagcctgtggccaagctgcccccgcgccgggacgactggcctccaggatgcagagacaagggggcccggggctccaccggccggaaggtgggagtcagcaaggcgcctgaaaagtgagcatggtgcgtggggcctggcccccatgcagccgccacaccgccctctgttcaaggcagggccagctccgggacctctgtcctccagttctccatcccccacccccgcctcttcatccgtccagtggggcagccagccactctcccttccctgaaggtggcccttcccctgttaaggctgccacagggcacacctgggttggggctccccaaggtgtgcccagcagaagtgcaatagccaggagggttgcccctcctcatgggaatgtgtctggggtcttggtgccacaggggctgcagcgcagagtaggcagatggcctttggccccccggctccgcttcctcaggccctgccgggtcccttccctggctaccccaaggctcaggcatccctggtgacctgtggttctgggctggtgagggcacctgagcaacctggcacgggcagccaccatcctggcctcacctccacccaacactggaactccagcacccccagctacctcccaggacagacccctgtctgaccactgccatgctgacctgacaggctccggcctgcccttggccacccacttggtccccttgcttctgttttctacctctccaggcctgcccactacccccacccctgctcctcctttgtcagtgcgatccctgctgtgctcaggccctgccccccaggcctgtctgtaattctcccagcttggggcaagggaggggttttgcttcttgtacctacagggcagcagaagcttgatgcccttcaacacagctgccagccctgggggtgtggggcccctggagtgtgctctcctccagtgttcagccttctggcactgcaggcctaggttggagcagcctcgtggagtagggacggactagttcgggccctggggtcttgctggggcccataggcatgtggggcaggaagctgggcagagctggcctggctctgagtggccactgggggaaaggcagccttctgtctgccaatctgggtaggcccagtggccaagctctcatgggagccccctccccacttttttttttaacctgcccccattgtttctggttgtgtggtcatttgatatgggaactgaaggccagccaggggaggggcttggccaaagtcacagcaggttgatggcagctccagagctgtctttgcccctttgtggccctgaggacggctgggtctataggtagggcaggggtcaggcagggagtccagggtgcctggaagaggtggccacagcctgtggctccctccctggggtcctgccttccaaccacggcattgcagggaggatgaggctcagagggggtaggtttggagggaggccattttccagggtgggtgggagtgggctgagggctcggccccactgaccctggacgatgagaattttgatgtttgcccgtgtgcgtgtgtctcctgggtgtagtggatgccagtcttgttgctgtgacaagtaacaaccttttttttaaattgttttttatacaaacactcgcaatccgacatttggtgctaagggtttcctggtgcagacggtgggcctgggggctgggctggaccagggcgtgggtctctggggttggggtcccttgctgctcagggaggcagtactgactgggcactgcctctgcccccagcacccaccctcccccattccccagggagaaggggccccactgggcttggcctgcagtagtagggagacaagttccaggagcactttggggactggggttgcagaacacttcctgtctctggcttcatccttgggccagaaggctccaaccctcagcagcccttgccagatgtgccagggagtgggtgtggagacccggactccccccacccacgcacacctcggcctgatgagaggatggaggctggggcagagatgggcgtgacccagcgtcagagggtcgggggaggcattccttcctgtgtcccagagcttcactggtggagctggaggagccggaggtggagggtggggtctggcagctgctgctggggcagcctcatgaggggaggggaggggaggggaggggagcaggcactgggcgggggcctaggtgcactttgtccttgccaccaatggcgggaggagggtggacctgaacacctgcagggtgtggtgcctgccccagcctctcaggtacttggcccttggggagaagagaagagggtctggtttttgctgggggtgagtttccgggacactcccaaagcccacagataatccctggtgtgggaagaggagtcctggataccttgatgtttagcactttaaccccctttgtctttaaggtaggcgtgggggctactgccagaagtggctgttgggtctgaccccctcctttctgccctccctctgccacatgctggtccgcagagccctcctcccaaggggtggggccctgggtggagctcagcagggtctgcccactccctacgctggcccacataggcctccaggagccctcagtgagagggaccagcatagctgacccccagagtgtggtgggcgccggccctgcccgaggcccagtcggggccctttctgcagatctacctctggctcagcgcacgccccctgccctgagaacaggaaagggcccggaagggctgactcaccgggccgacgctcacacgaaaatgggatgcactttatttgctggtgcaaaggcaggtgagggtgcctcctgtgtgaccgttggccctcctgcctggtggcgctgaagggaaggagccagtgagcctgaccccgggaggggccgtccccgtgtgccgcgtttggcggggccccaggcggctcccccaggcccgggtctggggccccaggctttcccctgcctcgcggccgggcgtcccgtgctttgggtttcttggtttgggttttttaatgccagttctcagtacataagtgcattttgaaagaggttccagctatcacttgtaaccatatatatatacatatatattctatctacaaagtgtttatttgcgagatgtttcaacggtgagttcgggccccgcccgccttgtgaccatctgtccccggtcctcgtccccgccccgcgccctggtcccgagtggcgtggggacgggccatcactgtatgtattaaaatgactgtatcaaataaatgtttattgatttttttcc

SEQ ID NO: 202751 - DNA, 2139 bp, Homo sapiens
  Payload ID: 19989
  Gene Name: zinc finger protein 513
  Uniprot ID: Q8N8E2
  ENST ID: ENST00000323703
  CDS Start-End: 200-1825
catgaatggaagcggcggcggcggcgggagcggcctgagctgggcgccggggccagggccgggggctgcccagggcccgcgccgctgcatgggggcggcccgcgggccctgagaggaagggcagacaggcgggccgagataggaggggcggggtcgggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagcca

SEQ ID NO: 202752 - DNA, 2077 bp, Homo sapiens
  Payload ID: 19989
  Gene Name: zinc finger protein 513
  Uniprot ID: Q8N8E2
  ENST ID: ENST00000407879
  CDS Start-End: 328-1767
aggagcgggggtggggtcagtggagtgggctcaggtcagggtggagggggactcctgagggatgaagtgggcgatccagactcctagcttcccaccgaggcactaagggaatcagagtgggtcagcgagtacgggaagtgtggtccacgagggctggttcctgagggagaatccacaagccccctcccctcttcagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaa

SEQ ID NO: 202753 - DNA, 510 bp, Homo sapiens
  Payload ID: 19989
  Gene Name: zinc finger protein 513
  ENST ID: ENST00000436006
  CDS Start-End: 162-510
gcggcggcggaagcggaagcgagtacggagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttcc

SEQ ID NO: 202754 - DNA, 3011 bp, Homo sapiens
  Payload ID: 19990
  Gene Name: zinc finger protein 514
  Uniprot ID: Q96K75
  ENST ID: ENST00000295208
  CDS Start-End: 464-1666
ggcgcggggtggcgggcggggcctggtcctgtgagcgttcggagactgcgggcgcgcagacctgtactgggcccgcgccccggccccttacagagctgggtgtgtccctccgagtgccccccgctagggactgtgcaggccggagctaggcagggacagcggggcgaaccgggctgatagagtcggtccctgctcctgtgaggctctcaccgaatccctgctgtttccgggcagctgaagagcgctgggccctcgcgtcgcgggcgtggctgtggccgtgtctcctggtagtctgagcccactgtgcgtgtggatccacgtgggagctgggttccagagcctggtcctgaggaggagccgagccggggcttccccttctcagaatcctgctcttcctccagagagattcccaggagaagagggaacaaccaattcattcctgaaagccaggcctcgggacctgatgacatttgaagatgtggctgtggaattcagccagtgggagtgggggcagctgaaccctgctcagaaggacctctacagggaggtgatgctggagaacttcaggaacttggccattctgggccttctagtatccaaaccatatgtgatctgccagttggaggaagggggtgagcccttcatggtggagagagaaatctcaacaggagcccactcagactggaagagaaggtctaaatccaaggaatcaatgccaagttggggaatttccaaagaagaattattccaggtagtatcagtggaaaaacacattcaagatgtgctgcagttctcgaagttgaaagcagcctgcggttgtgatggccagttagagatgcagcagataaaacaggagagacacctgaaacaaatgtcaaccattcacaaatctgccaccacccttagcagagattataaatggaatggatttgggagaagcttaggtttaagatcagtccttgttaaccaacacagcattctcatgggagaaggatcttataaatgtgatacagaattcaggcagactttagggggaaacaactctcagagaacccacccagaaaagaaatcttgtaaatgtaatgagtgtgggaagtcctttcacttccagtcagaacttaggcgccatcagcgatgtcacactggagaaaagccgtatgaatgcagtgactgtggaagagcctttggtcatatttcatcccttattaaacatcaaagaactcatactggagaaaagccctatgaatgcagtgaatgtgggagagccttcagccagagttcgtctcttgttctgcactatagatttcacactggagagaaaccctacaaatgtaatgaatgtggacgagcctttggtcacacttcatcccttattaagcatcagaggactcatactggagaaaagccctatgaatgccgggaatgtgggagaaccttcagccagagctcatcactcattgtgcattacagatttcatactggagagaaaccttacaaatgtaataaatgtgggagagccttcagccagagttcatctctcactcaacattacagatttcacactggagagaaaccctacaaatgtaatgagtgtggaagggcctttgctcatactgcatcccttattaaacatcagagaagtcatgctggaaaaaaaaccctataaattcagtgaatatagaagggctttcagctggagtgcagacatcactggaacttaaagaattcatatcagagagagatcctaaaggtgtaatgtatgtgggaagaccacatcttgttccacatcaggcaataattactaaagagaatccctgtcaatgtcaagagggggtgggcttcccctctcttaccaaacatgggagaatccatactagtgagaaaccacgtgaatgtaatgaatgtgggaacgctttgatcagaggatgcatattattcagcatcagacagccgacactggggaggagccttatcaatgcagtgagtgtggcaagccttcagttacatactgattctttaagaaaatcagataacttgtactggagagaaatcctacaagtgtggtaagtatggaaaaatcttcagttgtatctcttcctttactaagcatcaagaacacatactagagagaggccctatgaaagcaggaaatagaggaaggccttcagtcagggctcatcccttattaagcatcagaaaattcatacctgagaaaaacctgtgaatgtgggtaatgtgggagagccttcagccaaacctcattgctttataaaccccttagaactctccctactagctggaaactctggtgacgtgatgaatgtgggaagggctttggtggatgttccaccaaaacacgttagagaatttgtacattagagaatttgtgctagagcaactcttcaaatttagtgaaactgggaaaacccattagtagagttcaagcttcagtattcatctcaaagagaaaccttgggaacatgatgaatgtgaggaaagttcctttccaacttgagatgtataaaactagagctgaaaagaagctgagaaatcaccttgtctggtgattttctgcctggtggggccatttgtataacgacacttgtgcattgcctcctcatgctgttactgacggggcagggtgtcatgcatgggtgcagaggatggaggctgagaaaggtagacagctacccatgatctagcccagtcgtattttagagctaataaaactgatgttcagaaagtgacatgccttggcctatagtcctaactgggctgggcctctttcctgtggttcacagctgtagtatggagattaatagactggatctttgcagtacaacacctctatgcacttctttctctgtagcacatgttacctttctttgtgaggcaatggagtggtctaggattgagcaaaaagcaatttttgttacatctttatgctaatagatttggaatttttgaaatgaaatgaaaccttgtttaaacattaaaattactaaaatagg

SEQ ID NO: 202755 - DNA, 554 bp, Homo sapiens
  Payload ID: 19990
  Gene Name: zinc finger protein 514
  ENST ID: ENST00000447814
  CDS Start-End: 342-554
gcttgcccactttcaggaatttgattctgagagcagggctgcggttccaggcagggtttgtacacatatttgcgttggaaggagagaggagcctaggacacatatgtattaactgtgcagctggtccgactcccgacagcttcagcgcacaccagccagccttggagttgctggaacggccctggctgcaagctggaatcacccggagagctttcgacattgatgcctgaggcccagctgtggagcgacagtttgaaaagagctgcaggtgactctaatgtgcagctaaagctaggaaccactgagctacatctcagggaagactgaaaattacaaagaatatgataaaatcttacttcaggaacaaagctacgtttttccaggacctgatgacatttgaagatgtggctgtggaattcagccagtgggagtgggggcagctgaaccctgctcagaaggacctctacagggaggtgatgctggagaacttcaggaacttggccattctgggccttctagtatccaaaccatatgtgatctgccagttggaggaa

SEQ ID NO: 202756 - DNA, 2755 bp, Homo sapiens
  Payload ID: 19990
  Gene Name: zinc finger protein 514
  Uniprot ID: Q96K75
  ENST ID: ENST00000411425
  CDS Start-End: 574-1776
tgtggccgtgtctcctggtagtctgagcccactgtgcgtgtggatccacgtgggagctgggttccagagcctggtcctgaggaggagccgagccgggggtaggaggccggacttggcgagggaagagcacgaccccgggcagcagtgcgccgcgctgggcgcaccggggtttgccggccctgctctgggccctgcaggtccgctggccccgccgcgcctagtggggatgccccgtgtcccccaggcagccccagcctgcgtcccgctccctgaaccctcgggaggaccacagggctgtggccgaaagacagagatttggacctagtgaaaggacgccgctccttagccccagctatggactccacagcatcaggtttggctctggagcgtgcagagggccaggagccctcttggggagctagtaccgagcccgatatcaggaggaccccaggaagaggccggggaatcccactgaaggcttccccttctcagaatcctgctcttcctccagagagattcccaggagaagagggaacaaccaattcattcctgaaagccaggcctcgggacctgatgacatttgaagatgtggctgtggaattcagccagtgggagtgggggcagctgaaccctgctcagaaggacctctacagggaggtgatgctggagaacttcaggaacttggccattctgggccttctagtatccaaaccatatgtgatctgccagttggaggaagggggtgagcccttcatggtggagagagaaatctcaacaggagcccactcagactggaagagaaggtctaaatccaaggaatcaatgccaagttggggaatttccaaagaagaattattccaggtagtatcagtggaaaaacacattcaagatgtgctgcagttctcgaagttgaaagcagcctgcggttgtgatggccagttagagatgcagcagataaaacaggagagacacctgaaacaaatgtcaaccattcacaaatctgccaccacccttagcagagattataaatggaatggatttgggagaagcttaggtttaagatcagtccttgttaaccaacacagcattctcatgggagaaggatcttataaatgtgatacagaattcaggcagactttagggggaaacaactctcagagaacccacccagaaaagaaatcttgtaaatgtaatgagtgtgggaagtcctttcacttccagtcagaacttaggcgccatcagcgatgtcacactggagaaaagccgtatgaatgcagtgactgtggaagagcctttggtcatatttcatcccttattaaacatcaaagaactcatactggagaaaagccctatgaatgcagtgaatgtgggagagccttcagccagagttcgtctcttgttctgcactatagatttcacactggagagaaaccctacaaatgtaatgaatgtggacgagcctttggtcacacttcatcccttattaagcatcagaggactcatactggagaaaagccctatgaatgccgggaatgtgggagaaccttcagccagagctcatcactcattgtgcattacagatttcatactggagagaaaccttacaaatgtaataaatgtgggagagccttcagccagagttcatctctcactcaacattacagatttcacactggagagaaaccctacaaatgtaatgagtgtggaagggcctttgctcatactgcatcccttattaaacatcagagaagtcatgctggaaaaaaaaccctataaattcagtgaatatagaagggctttcagctggagtgcagacatcactggaacttaaagaattcatatcagagagagatcctaaaggtgtaatgtatgtgggaagaccacatcttgttccacatcaggcaataattactaaagagaatccctgtcaatgtcaagagggggtgggcttcccctctcttaccaaacatgggagaatccatactagtgagaaaccacgtgaatgtaatgaatgtgggaacgctttgatcagaggatgcatattattcagcatcagacagccgacactggggaggagccttatcaatgcagtgagtgtggcaagccttcagttacatactgattctttaagaaaatcagataacttgtactggagagaaatcctacaagtgtggtaagtatggaaaaatcttcagttgtatctcttcctttactaagcatcaagaacacatactagagagaggccctatgaaagcaggaaatagaggaaggccttcagtcagggctcatcccttattaagcatcagaaaattcatacctgagaaaaacctgtgaatgtgggtaatgtgggagagccttcagccaaacctcattgctttataaaccccttagaactctccctactagctggaaactctggtgacgtgatgaatgtgggaagggctttggtggatgttccaccaaaacacgttagagaatttgtacattagagaatttgtgctagagcaactcttcaaatttagtgaaactgggaaaacccattagtagagttcaagcttcagtattcatctcaaagagaaaccttgggaacatgatgaatgtgaggaaagttcctttccaacttgagatgtataaaactagagctgaaaagaagctgagaaatcaccttgtctggtgattttctgcctggtggggccatttgtataacgacacttgtgcattgcctcctcatgctgttactgacggggcagggtgt

SEQ ID NO: 202757 - DNA, 8118 bp, Homo sapiens
  Payload ID: 19991
  Gene Name: zinc finger protein 516
  Uniprot ID: Q92618
  ENST ID: ENST00000443185
  CDS Start-End: 319-3810
cggggcgtgcgcgtcctcctccccaggcccgccgcctccctgccaagaatctgagagaggccgagtggagttcggtccttctctgaacacttttagctgagagtaccagcatccaactgggagcgttgtcattgcatttccacattcccaggaaagcccaggtgctggctgccagctgctgcgccccccatgtagaaggtgcacctcctgggagcaggcacgtcttttggctcttctgaccatggagagataggacggtccctgcagcccgcgcgacagaaagctgtgccgccaccaccggccgcgcccgtccttcggatggatcgcaacagagaggccgagatggagctgaggcgaggccccagccccaccagggccggccggggccacgaggtggatggggacaaggctacctgccacacctgctgcatctgcggcaagagcttccccttccagagctcgctttcgcagcacatgcgcaagcacacgggcgagaagccctacaagtgtccctactgcgaccaccgggcttcccagaagggcaacctgaagattcacatccggagccaccgcacggggactctgattcagggacacgagccggaggcgggcgaggcgccgctgggtgagatgcgcgcctccgagggcctggacgcctgcgccagccccaccaagagcgcctcggcctgcaaccggctgctgaacggggcctcgcaggccgacggcgccagggtcctgaacggggcctcgcaggccgacagcggcagagtcctgctgcggagcagcaagaagggggcagaggggtccgcatgcgccccgggggaggccaaggcagcggtccagtgctccttctgcaagagccagttcgagcgtaagaaggacctggagctgcacgtgcaccaggcgcacaagccgttcaagtgcaggctgtgcagctacgcgacgctgcgggaggagtcgctgctgagccacatcgagagggaccacatcaccgcgcaggggcccggcagcggcgaggcctgcgtggagaacggcaagcccgagctgagccccggggagttcccgtgcgaggtgtgtggccaggccttcagccagacctggttcctgaaggcgcacatgaagaagcaccggggctccttcgaccacggctgccacatctgcggccgtaggttcaaggagccctggttcctcaagaaccacatgaaggcgcacggccccaagacgggcagcaagaacaggcccaagagtgagctggaccccatcgccaccatcaacaacgtggtccaggaggaggtgatcgtcgccggcctgagcctctacgaggtctgcgccaagtgcgggaacctgtttacaaacctggacagcttgaacgcccacaatgccatccaccgcagagtcgaggccagccgcacgcgcgccccggccgaggagggggcggaggggccctcggacaccaagcagttcttcctccagtgcctgaacctgaggccgtcggcggccggcgactcgtgccctggcacgcaggccggacggcgggtggctgagctggacccggtcaacagctaccaggcctggcagctggccacgcggggtaaggtggccgagccggccgagtacctcaagtacggggcctgggacgaggcgctggccggggacgtggccttcgacaaggacaggcgcgagtacgtcctggtgagccaggagaagcgcaagcgtgagcaggatgcaccagccgcgcaggggcccccgcggaagcgcgcgagcgggcctggggaccccgcgcccgccggccacctcgatccccgctcggccgcgcgccccaaccgcagggccgcagccaccaccggccagggcaagtcctccgagtgcttcgagtgcggcaagatcttccgcacctatcatcagatggtgctgcactcacgcgtgcatcgccgcgcgcgccgcgagagggacagtgacggggacagggcggcgcgggcccgctgcggatcactcagtgagggtgactcggcctcccagcccagcagccctggctccgcctgtgccgctgctgactccccgggctctggcctggccgacgaggctgccgaagacagtggtgaggagggcgcccctgaacctgcaccagggggacagccgcgccgctgctgcttttccgaagaggtgacttcgaccgagctctccagtggagaccagagtcacaagatgggagataacgcctcggaaagagacaccggcgagtccaaggcagggatcgcagcttctgtgtccatacttgaaaacagtagcagagagacttctagaaggcaagagcagcacagattttctatggacttaaagatgccagcatttcaccccaagcaggaggtgcccgtccctggtgatggtgtggagttcccttccagtacgggagcggagggccagacgggtcaccctgcagaaaagctgtccgatttgcacaacaaggaacactctgggggagggaagcgggcgctggccccagacctcatgccgctagatttaagtgcgaggtcgacgcgggatgaccccagcaataaggagacggcctcctccctgcaggcggctttagtcgttcacccgtgtccttactgcagccacaagacctactaccccgaggtcctgtggatgcacaaacgcatctggcaccgcgtcagctgcaactccgtggctcccccgtggattcagcccaatggttacaaaagcatcagaagcaatttggttttcctttcccggagcggacgcacgggccccccgcctgccctcggtggcaaagaatgccagcctttgctccttgctcggttcacccgcactcaggtgccaggggggatgccggggtccaaaagtggctcttctcccctgggagtggtcacaaaagccgctagcatgcctaagaataaggagagccattccggaggtccctgcgctctgtgggcgcccggccctgacgggtatcgacagaccaaaccttgtcacggccaggagccacatggcgcggccacacaggggcccctggccaagcccaggcaggaggctagctccaaaccggtgcctgccccgggtggcgggggcttcagcaggagcgccacccctacgcccaccgtcatcgcccgggctggcgcgcagccctcggccaatagcaagcctgtggagaagtttggggtccccccagcgggggctggctttgcccccacaaataagcacagtgccccggactccctgaaagccaaattcagtgctcagcctcagggtccacctcctgcaaagggcgaagggggcgctcctcctctacctccccgcgagcccccctcgaaggcagcccaggagctgaggactctggccacctgtgctgcggggtccaggggcgacgcggccttgcaggcccagcccggcgtggctggggcgccccccgtcctacactccatcaaacaggagccggtggccgaggggcatgagaagcgcctggacatcctcaacatctttaagacgtacattccaaaggactttgcgaccctctaccagggatggggtgtcagcggccctgggttggagcacagagggacactccggacgcaggcccggccaggagagttcgtctgcatcgagtgcggaaagagcttccaccagcccggccacctcagggcccacatgcgggcacactcagtggtgtttgagtccgatgggcctcggggttctgaagttcataccacctccgcagacgcccccaaacaagggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaatacatgtagatactatatacgcatttacgtgctcatcgtccatagtcccatattttcttataataaacagtagtactggcaggcacagtaggggcacaaggcatctgtcttattcaagacaagtttgagacactggaaaaaaagatacttgttgtgtgtgttggacagagtggcgaggctgagcactgtcacaggggcctcccatgttaagagggactgtggggatgatgtcagaacaagacgtggtggatttgaggttgatcgagtattaatactactgcctctccttgtcttagtgggtatttaaaatagtaaataagagagaggaaggaggtgacgttcaggtgctgtgggaagcaggcttggcggaggggtatgatgatgagaccctcattgttcactggctccatcgcactcctccctggggccgtgtgcctgttccattcttcccaccattcgaactgagcgaatctggcaaaggagacacgtctgtgggaatgcgtagattccgcctcggaagagagctagcgcaacactaagaaaagcaggcttcttgtttattctcaggacctttttgtaacagggctacattctgcaaactgcttacaaaggaagactatacgtcttaacaaattatttagccactgagtcctcccgattcggacctgttttagtaatggcagaagaatccctgagcaggttcaggtgccctagatgactagggtgctgagctctggcgccttctgtccccactctttgcctccccgccccttccctgagccaccccagcaagtgggtgtcttttctccctgggcctggtgacctccacaggatgagtgactttgttcataaagggtggggatcaccagccccttgggtgggggacggcttcatatacctcttcctcagtaatgcaaatgcgagtttttgtggtgggggttaaggcccataacaaaggatcttaaaccatgcagtgtacgcaattgaaatggtattccacagatataaatattttcttttcccattgccgtgacactatgtgtgatggtaatatttctgagagtttcagatttttgcacatatgattttatgcattatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattattattgttattgttattagtaatgtttggttctggattctacttgttactgagtttaaattacttgacggttcaggttactttgcaacactttcaaacgatgcaatgtaactggctagcttatatatatatatatatatatatatatatatatttttttttttttttacttatttttttctgatattcttacaccagatatgtacgaaaatgatctgtcctgttggtgtaattaggaatgtccatgcagatacagttaaacaactgtaattgactgttctgtaaagttattttgggcaaagttgcggagacacattcctctgtccacctaagaaatcagaagactcttctgttgatttatgtttaatcatttcagtagtttccccacagtgatcatttctgcattttctggcttttgttttcttggctgaaagtgaatggtgactgttaggaatgtcagggactagtgacccagtcctgtttctctgtgttttagttattaaaaagaaattctgtacccaaagtgacacgaaagtgtagtctacatttttactgtttcagaagcggcatggaaaagtgcagttggcctttggagctggaagtgtcttgctggtgaggctccatcctggaggctctggtggggagtgggctggcgctggggccctgccggccgcgtgctggatccttcctggcttgcaggagagcaggcgtggaggacagtcagcttgcggggccgcgcagggtgcacagagtgcaggaggaaggttttcacccagttaaacagactggggagcccccccaagaacgccatcccttgaggccagctgtgggcaggcctggatgtgtggtcccttccttccacccatcgtcagtattgtgttggtttgttaatttgttgatttggtcatagtatttaatatgatttgtgtttccttatttatttagccaccgttttgattgcctttttttttccgaatggtaatttctgcatgatacacttctgtacgttgtcttctgactgttacagactttctactacctctcccgatctgctgtttccttgtttcttaacaggattttttacagtgttgcgtctaatgtaacttagacaataaagggtttggttgtctacactgcagcttctcggtgtctctcccctgctttccgctcgctgcttcccgctctgcccctgctggggcctggctgcaccctggcctgccttcctatactctcctgtttcctgctcatatctcttcctcatttttgcgttcaaataacacacagctaatgagcttctaaaaatcttttcaggttgttcacttgtattccttaatttgaagaatgaatatttaaattctctcaaaagtcagatattgaggatcttctctgggaaattggccactgtacctgcccacctttctgcctggttccctggaaggtcttattgtcatcttagacggacagatttcattctcagcaccatacagatttggcttcaaagccaggtgaattttgcctttgaggctctgaaaagtattaagtgttttaagaggtcccccaatatttacttatttattttttaaaccaagaaagacactggttccctgaaaagcaggtgcttcaggaagtagcaattgggagttgcatacagttacttcgtcagagaaaggagcgcccagtatgacaggcccccacccctgatccggccactgtgcacaggtcgctgagggtgtgagaacacctctgcaggggctccggcacatgtgggtttcatcgtctcacactccttcaggctgcaggggttgagtgcagaaagggcaagcttcatctccatggtgcctctccaggctggcaactctggtcggcctctgttctttggacagagagggtgtaggttacagggtcagtagggatgctttctggatcaaagaaagtgggtgtagtgcttagtctgttgtgtggaagagggcacctcctgggctttcgtggctggagactgtctaccaacattccttccttcaaactagacaaaccctcctctgccacccccagcaaattctcagaggtttccaagctgtagaaaaaggaaggaaggaaggacggcattcacatagctttactttctgcttcaaaatgtcttaagtagcatatgttgttttactgcttttaactttggtgagttctaatttcagaacgttttgttcactgagcaaaaaaacagatgaaacaaccacaggccaggacttcaagtgaggaggacgcctttgtttgccgtggttggtgggagcacacgccggagcccggtaacgtgcctgtgggagtgaccaagggccacccgcccaagggaaaatgttcattcttcatcagctttgctaattctgctttgaggcagtaaaatgcaaaagaccatagaatttgtatttctttttttaaaatacaatttataacattatattttgtactctttatattagaatttgtaactagattgatgtatttaactatttctgaaaaagtaattcaatgttttagttgtgtgataaaaatatttagataaaacatattcattctattggaatttgaaataaataaaaacatcttggagttctga

SEQ ID NO: 202758 - DNA, 346 bp, Homo sapiens
  Payload ID: 19991
  Gene Name: zinc finger protein 516
  ENST ID: ENST00000542818
  CDS Start-End: 1-76
ggactttgcgaccctctaccagggatggggtgtcagcggccctgggttggagcacagaggggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaa

SEQ ID NO: 202759 - DNA, 482 bp, Homo sapiens
  Payload ID: 19991
  Gene Name: zinc finger protein 516
  ENST ID: ENST00000532857
  CDS Start-End: 257-482
aagtcacaaaaggaactttagtggggatcctacttacacatacagcagaaaggcattgcccccgtcagcctgccatgcagtttcgaatcttgattgaaggtgctggctgccagctgctgcgccccccatgtagaaggtgcacctcctgggagcaggcacgtcttttggctcttctgaccatggagagataggacggtccctgcagcccgcgcgacagaaagctgtgccgccaccaccggccgcgcccgtccttcggatggatcgcaacagagaggccgagatggagctgaggcgaggccccagccccaccagggccggccggggccacgaggtggatggggacaaggctacctgccacacctgctgcatctgcggcaagagcttccccttccagagctcgctttcgcagcacatgcgcaagcacacgggcgagaagccctacaagtgtccctactgcgaccaccgggcttcccagaagggca

SEQ ID NO: 202760 - DNA, 2326 bp, Homo sapiens
  Payload ID: 19991
  Gene Name: zinc finger protein 516
  ENST ID: ENST00000617840
  CDS Start-End: 1-1553
gctgcttttccgaagaggtgacttcgaccgagctctccagtggagaccagagtcacaagatgggagataacgcctcggaaagagacaccggcgagtccaaggcagggatcgcagcttctgtgtccatacttgaaaacagtagcagagagacttctagaaggcaagagcagcacagattttctatggacttaaagatgccagcatttcaccccaagcaggaggtgcccgtccctggtgatggtgtggagttcccttccagtacgggagcggagggccagacgggtcaccctgcagaaaagctgtccgatttgcacaacaaggaacactctgggggagggaagcgggcgctggccccagacctcatgccgctagatttaagtgcgaggtcgacgcgggatgaccccagcaataaggagacggcctcctccctgcaggcggctttagtcgttcacccgtgtccttactgcagccacaagacctactaccccgaggtcctgtggatgcacaaacgcatctggcaccgcgtcagctgcaactccgtggctcccccgtggattcagcccaatggttacaaaagcatcagaagcaatttggttttcctttcccggagcggacgcacgggccccccgcctgccctcggtggcaaagaatgccagcctttgctccttgctcggttcacccgcactcaggtgccaggggggatgccggggtccaaaagtggctcttctcccctgggagtggtcacaaaagccgctagcatgcctaagaataaggagagccattccggaggtccctgcgctctgtgggcgcccggccctgacgggtatcgacagaccaaaccttgtcacggccaggagccacatggcgcggccacacaggggcccctggccaagcccaggcaggaggctagctccaaaccggtgcctgccccgggtggcgggggcttcagcaggagcgccacccctacgcccaccgtcatcgcccgggctggcgcgcagccctcggccaatagcaagcctgtggagaagtttggggtccccccagcgggggctggctttgcccccacaaataagcacagtgccccggactccctgaaagccaaattcagtgctcagcctcagggtccacctcctgcaaagggcgaagggggcgctcctcctctacctccccgcgagcccccctcgaaggcagcccaggagctgaggactctggccacctgtgctgcggggtccaggggcgacgcggccttgcaggcccagcccggcgtggctggggcgccccccgtcctacactccatcaaacaggagccggtggccgaggggcatgagaagcgcctggacatcctcaacatctttaagacgtacattccaaaggactttgcgaccctctaccagggatggggtgtcagcggccctgggttggagcacagagggacactccggacgcaggcccggccaggagagttcgtctgcatcgagtgcggaaagagcttccaccagcccggccacctcagggcccacatgcgggcacactcaggggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaatacatgtagatactatatacgcatttacgtgctcatcgtccatagtcccatattttcttataataaacagtagtactggcaggcacagtaggggcacaaggcatctgtcttattcaagacaagtttgagacactggaaaaaaagatacttgttgtgtgtgttggacagagtggcgaggctgagcactgtcacaggggcctcccatgttaagagggactgtggggatgatgtcagaacaagacgtggtggatttgaggttgatcgagtattaatactactgcctctccttgtcttagtgggtatttaaaatagtaaataagagagaggaaggaggtgacgttcaggtgctgtgggaagcaggcttggcggaggggtatgatgatgagaccctcattgttcactggctccatcgcactcctccctggggccgtgtgcctgttccattcttcccaccattcgaactgagcgaatctggcaaaggagacacgtctgtgggaatgcgt

SEQ ID NO: 202761 - DNA, 2335 bp, Homo sapiens
  Payload ID: 19992
  Gene Name: zinc finger protein 517
  Uniprot ID: Q6ZMY9
  ENST ID: ENST00000359971
  CDS Start-End: 108-1586
ggaaccggagcctgagagccgggcgccgtgcgctcctccccgcgctgtctcggcggcccaggaattcactgtctgtagcatctgctcctccacagagggaccctggaatggcgatggcactcccgatgcctggacctcaggaggcggttgtgttcgaggatgtggctgtgtacttcacaaggatagagtggagttgcctggcccccgaccagcaggcactctacagggacgtgatgctggagaactatgggaacctggcctcactaggctttcttgttgccaaaccagcactgatctccctattggagcaaggagaggagccgggggccttgattctgcaggtggctgaacagagcgtggccaaagccagcctgtgcacagattccaggatggaggctgggatcatggagtctcctctgcagagaaagctctccaggcaggcaggactgccgggcaccgtgtgggggtgcctcccctgggggcaccctgtgggggggcaccctgcaccaccccacccgcatggcggtcctgaggacgggtcagataaacccacccacccccgggctcgggagcacagcgcctccccaagggttctgcaggaagacctgggccggcctgtggggagctcagccccccgctacaggtgcgtgtgcggcaaggcgttcagatacaactcgctgcttctcaggcaccagatcatccacaccggcgccaagcccttccagtgcacagagtgcgggaaggccttcaagcaaagctccatcctgctgcggcaccagctgatccacactgaggagaagccgttccagtgcggcgagtgcgggaaggccttccggcagagcacgcagctggctgcccaccaccgcgtccacacccgcgagcggccctacgcatgcggcgagtgcggcaaggccttcagccgcagctcccggctgctgcagcaccagaagttccacaccggggagaagcccttcgcgtgcacagagtgcggcaaggcgttctgccgcaggttcaccctcaacgagcacggccgcatccacagcggggagcggccctaccggtgcctgcggtgtgggcagcgcttcatccgagggtcctcgctcctgaagcaccaccggctgcacgcgcaggagggtgcccaggacggcggcgtggggcagggcgccctgctcggagctgcgcagaggccccaggcgggggacccgccccacgagtgcccggtgtgcgggaggccgttccgacacaactccctgctgctgctgcacctgcgcctacacacgggcgagaagccgttcgagtgcgcggagtgcggcaaggccttcggtcgcaagtccaacctcactctgcaccagaagatccacaccaaggagaagcccttcgcgtgcaccgagtgcggcaaggcgttccgcaggagctacacgctgaacgagcactaccggctccacagcggcgagaggccataccggtgccgcgcctgcgggagggcctgcagccggctgtccaccctcatccagcaccagaaggtgcacggccgcgagcccggggaggacacagagggcaggcgggcgccctgttgggcttcctgatgacggggacgacaggccgaggattcacgctggaagcccacccaagccggcggggccctagcgcagaaattcagaaccccctgtcctgaaggtgaagcaaagtctaaagaaagggccagctcccatcaggagctcggcttcttgctccagccgggcactggggagggaaagggcaccaggcagcccgtggtgtggcctcaggaaccactatcagccaccatttcctggggccttccggaaatgtccaggagcgggcagaagggagagagggaggggcagctatgctcagtccccaaagagcagggcacagggggcgccacagacgcatatgcagctgagctccccacaggccggcccgggtcttcgtgcagaaccattgggcacagccaggccttagcgccaggctccgtgtggcggtcaattccaggtgctgtaaagccgactaacagggtacagggagccttagctggctgccatgtctcctgcctgtaatcccatcactttgggaggctgaggtgggaggtttgcttaagcccaggagtttgagaccagcttgggcaacatggtgaaacttctctacaaaaaatttaaaaataagtcaggtatcgtggtctgtgcctgtacgctgtagtcccagctactcaggaggctgaggtgggaggatgggttgagcctgggaagtcaaggctgcagtgagctatgatagcaccacggcactccaacctggttgacagagtgacaccctgttt

SEQ ID NO: 202762 - DNA, 1460 bp, Homo sapiens
  Payload ID: 19992
  Gene Name: zinc finger protein 517
  ENST ID: ENST00000529429
  CDS Start-End: 1-1379
tctgctcctccacagagggaccctggaatggcgatggcactcccgatgcctggacctcaggctttcttgttgccaaaccagcactgatctccctattggagcaaggagaggagccgggggccttgattctgcaggtggctgaacagagcgtggccaaagccagcctgtgcacagattccaggatggaggctgggatcatggagtctcctctgcagagaaagctctccaggcaggcaggactgccgggcaccgtgtgggggtgcctcccctgggggcaccctgtgggggggcaccctgcaccaccccacccgcatggcggtcctgaggacgggtcagataaacccacccacccccgggctcgggagcacagcgcctccccaagggttctgcaggaagacctgggccggcctgtggggagctcagccccccgctacaggtgcgtgtgcggcaaggcgttcagatacaactcgctgcttctcaggcaccagatcatccacaccggcgccaagcccttccagtgcacagagtgcgggaaggccttcaagcaaagctccatcctgctgcggcaccagctgatccacactgaggagaagccgttccagtgcggcgagtgcgggaaggccttccggcagagcacgcagctggctgcccaccaccgcgtccacacccgcgagcggccctacgcatgcggcgagtgcggcaaggccttcagccgcagctcccggctgctgcagcaccagaagttccacaccggggagaagcccttcgcgtgcacagagtgcggcaaggcgttctgccgcaggttcaccctcaacgagcacggccgcatccacagcggggagcggccctaccggtgcctgcggtgtgggcagcgcttcatccgagggtcctcgctcctgaagcaccaccggctgcacgcgcaggagggtgcccaggacggcggcgtggggcagggcgccctgctcggagctgcgcagaggccccaggcgggggacccgccccacgagtgcccggtgtgcgggaggccgttccgacacaactccctgctgctgctgcacctgcgcctacacacgggcgagaagccgttcgagtgcgcggagtgcggcaaggccttcggtcgcaagtccaacctcactctgcaccagaagatccacaccaaggagaagcccttcgcgtgcaccgagtgcggcaaggcgttccgcaggagctacacgctgaacgagcactaccggctccacagcggcgagaggccataccggtgccgcgcctgcgggagggcctgcagccggctgtccaccctcatccagcaccagaaggtgcacggccgcgagcccggggaggacacagagggcaggcgggcgccctgttgggcttcctgatgacggggacgacaggccgaggattcacgctggaagcccacccaagccggcggggccctagcgcagaaattcagaaccccc

SEQ ID NO: 202763 - DNA, 1383 bp, Homo sapiens
  Payload ID: 19992
  Gene Name: zinc finger protein 517
  ENST ID: ENST00000525105
  CDS Start-End: 46-474
aattcactgtctgtagcatctgctcctccacagagggaccctggaatggcgatggcactcccgatgcctggacctcaggaggcggttgtgttcgaggatgtggctgtgtacttcacaaggatagagtggagttgcctggcccccgaccagcaggcactctacagggacgtgatgctggagaactatgggaacctggcctcactaggctttcttgttgccaaaccagcactgatctccctattggagcaaggagaggagccgggggccttgattctgcaggtggctgaacagagcgtggccaaagccagcctgtgcacagaggaccctaatacactgcccagcagaagccaggaaggaagccctgccagctcagaaggtgggccaggagagaagggtgtggccggaagggtagccggtgggggtgctgcatcctcttggccccacggggagcaccctgtcacccctaacagatgaagagaaggtgaggggggattgagttacctgcccactggtgtgtcaaactccatgatgggggtgggaacatgcagacctggcccctccaaggcccactgctccccgggctgtgcgccccacagtctgtgccaggggctgcagaaagagccatgggaagcctggccctggtagggcaccaagatggggagggctggatccaccctccagagaacaagaatcctgggcagtagccgggacatggtgggggaggctgaagggttgtccctgagcatccccaacatggagctcggaagtctgggccatgggcaggaaagcacgaaggtcagggccagcctggggaaccaagagctgtgccacgatcccttccacctggggcagctgcccacatgcccgccactgggttccatcacctgagactcctggcaggtgcctctctgagtctttgtcctgtgctggaaactgggatgtgcagcacacatcttcacacccacagcacggacagcgggaataacacttcctttggggatccagggtttctggtgtctccagatttttcaggcgccaccatgttcctctcatccagacgtcagcacccaaggtggaagcaggtcatggcatgcccggcccagctgcagtccgagtgcagatcccatggcgagcgtgggatccagcccaaagcacaagccacgcacagcccgccaggttgagtgggcaggtacctccaacagccagcccaggttgagtgggcaggtacctccaacagcctggagccgtgaggccttgcgcaggggcgttgccggccgtggaggtctctggctggcaaagtggcaccgaaagagtcctgtgtcataaccagactcacttgtagcttctgttgctctccctagctatttgcaaagcatccaggat

SEQ ID NO: 202764 - DNA, 2536 bp, Homo sapiens
  Payload ID: 19992
  Gene Name: zinc finger protein 517
  Uniprot ID: Q6ZMY9
  ENST ID: ENST00000533965
  CDS Start-End: 108-1586
ggaaccggagcctgagagccgggcgccgtgcgctcctccccgcgctgtctcggcggcccaggaattcactgtctgtagcatctgctcctccacagagggaccctggaatggcgatggcactcccgatgcctggacctcaggaggcggttgtgttcgaggatgtggctgtgtacttcacaaggatagagtggagttgcctggcccccgaccagcaggcactctacagggacgtgatgctggagaactatgggaacctggcctcactaggctttcttgttgccaaaccagcactgatctccctattggagcaaggagaggagccgggggccttgattctgcaggtggctgaacagagcgtggccaaagccagcctgtgcacagattccaggatggaggctgggatcatggagtctcctctgcagagaaagctctccaggcaggcaggactgccgggcaccgtgtgggggtgcctcccctgggggcaccctgtgggggggcaccctgcaccaccccacccgcatggcggtcctgaggacgggtcagataaacccacccacccccgggctcgggagcacagcgcctccccaagggttctgcaggaagacctgggccggcctgtggggagctcagccccccgctacaggtgcgtgtgcggcaaggcgttcagatacaactcgctgcttctcaggcaccagatcatccacaccggcgccaagcccttccagtgcacagagtgcgggaaggccttcaagcaaagctccatcctgctgcggcaccagctgatccacactgaggagaagccgttccagtgcggcgagtgcgggaaggccttccggcagagcacgcagctggctgcccaccaccgcgtccacacccgcgagcggccctacgcatgcggcgagtgcggcaaggccttcagccgcagctcccggctgctgcagcaccagaagttccacaccggggagaagcccttcgcgtgcacagagtgcggcaaggcgttctgccgcaggttcaccctcaacgagcacggccgcatccacagcggggagcggccctaccggtgcctgcggtgtgggcagcgcttcatccgagggtcctcgctcctgaagcaccaccggctgcacgcgcaggagggtgcccaggacggcggcgtggggcagggcgccctgctcggagctgcgcagaggccccaggcgggggacccgccccacgagtgcccggtgtgcgggaggccgttccgacacaactccctgctgctgctgcacctgcgcctacacacgggcgagaagccgttcgagtgcgcggagtgcggcaaggccttcggtcgcaagtccaacctcactctgcaccagaagatccacaccaaggagaagcccttcgcgtgcaccgagtgcggcaaggcgttccgcaggagctacacgctgaacgagcactaccggctccacagcggcgagaggccataccggtgccgcgcctgcgggagggcctgcagccggctgtccaccctcatccagcaccagaaggtgcacggccgcgagcccggggaggacacagagggcaggcgggcgccctgttgggcttcctgatgacggggacgacaggccgaggattcacgctggaagcccacccaagccggcggggccctagcgcagaaattcagaaccccctgtcctgaaggatctctctgtcagccagcctggagtgcaatggcacaatcatggcttactgcagcctccagctcccaggctcaagcgtttctcccaccttagcctcctgagtagctgggactaaggcacacacactgtacttggcagctggcgaagcattgtttctgagtgtgtgaggatgttttcagtggactcagtgaagatctgccctcagcgtgggcaggcacatccacttggttggggacccagatggaacacaaagggagaagacaagcaaattctcttttctggagggagacacccatctcctgcccttggacatcaggactccaggttcttcggcctttggactcaggcttgccacagaggcctcccagggctctcggccagtcagcctcagaatgagagttacaccactggcttccttggttcaaccaccttcttacctggactgagcctcacttacagcttctctaggtctccagcttgcagacagcctatgggaggacttctcagcctccataagtgtgtgggccagttcgcctaataaatcccctctcctggccgggcgcggtagctctcccctgtaatctcagcattttgggaggcagaggtaggtggatcacctgaggtcaggagttcaagaccagcctggccaacatggtgagacccccgtctctactaaaagtacaaaaagtagctgggtgtggtgctgggtgcctgtaatcccagctactcgggaggctgaagcaggagaatcacttcaacctgggaggtagaggttgcagtgagccgagatcgagccactgcactccagcctgggtgacagggcaagactctgtctcaaacaaataaaaatcccctctcct

SEQ ID NO: 202765 - DNA, 456 bp, Homo sapiens
  Payload ID: 19992
  Gene Name: zinc finger protein 517
  ENST ID: ENST00000528012
  CDS Start-End: 67-456
gcgctgtctcggcggcccaggaattcactgtctgtagcatctgctcctccacagagggaccctggaatggcgatggcactcccgatgcctggacctcaggaggcggttgtgttcgaggatgtggctgtgtacttcacaaggatagagtggagttgcctggcccccgaccagcaggcactctacagggacgtgatgctggagaactatgggaacctggcctcactagcactgatctccctattggagcaaggagaggagccgggggccttgattctgcaggtggctgaacagagcgtggccaaagccagcctgtgcacagattccaggatggaggctgggatcatggagtctcctctgcagagaaagctctccaggcaggcaggactgccgggcaccgtgtgggggtgcctcccctgggggcaccctgtgggggggcaccctgcaccaccccacccg

SEQ ID NO: 202766 - DNA, 1615 bp, Homo sapiens
  Payload ID: 19992
  Gene Name: zinc finger protein 517
  Uniprot ID: Q6ZMY9
  ENST ID: ENST00000531720
  CDS Start-End: 46-1524
aattcactgtctgtagcatctgctcctccacagagggaccctggaatggcgatggcactcccgatgcctggacctcaggaggcggttgtgttcgaggatgtggctgtgtacttcacaaggatagagtggagttgcctggcccccgaccagcaggcactctacagggacgtgatgctggagaactatgggaacctggcctcactaggctttcttgttgccaaaccagcactgatctccctattggagcaaggagaggagccgggggccttgattctgcaggtggctgaacagagcgtggccaaagccagcctgtgcacagattccaggatggaggctgggatcatggagtctcctctgcagagaaagctctccaggcaggcaggactgccgggcaccgtgtgggggtgcctcccctgggggcaccctgtgggggggcaccctgcaccaccccacccgcatggcggtcctgaggacgggtcagataaacccacccacccccgggctcgggagcacagcgcctccccaagggttctgcaggaagacctgggccggcctgtggggagctcagccccccgctacaggtgcgtgtgcggcaaggcgttcagatacaactcgctgcttctcaggcaccagatcatccacaccggcgccaagcccttccagtgcacagagtgcgggaaggccttcaagcaaagctccatcctgctgcggcaccagctgatccacactgaggagaagccgttccagtgcggcgagtgcgggaaggccttccggcagagcacgcagctggctgcccaccaccgcgtccacacccgcgagcggccctacgcatgcggcgagtgcggcaaggccttcagccgcagctcccggctgctgcagcaccagaagttccacaccggggagaagcccttcgcgtgcacagagtgcggcaaggcgttctgccgcaggttcaccctcaacgagcacggccgcatccacagcggggagcggccctaccggtgcctgcggtgtgggcagcgcttcatccgagggtcctcgctcctgaagcaccaccggctgcacgcgcaggagggtgcccaggacggcggcgtggggcagggcgccctgctcggagctgcgcagaggccccaggcgggggacccgccccacgagtgcccggtgtgcgggaggccgttccgacacaactccctgctgctgctgcacctgcgcctacacacgggcgagaagccgttcgagtgcgcggagtgcggcaaggccttcggtcgcaagtccaacctcactctgcaccagaagatccacaccaaggagaagcccttcgcgtgcaccgagtgcggcaaggcgttccgcaggagctacacgctgaacgagcactaccggctccacagcggcgagaggccataccggtgccgcgcctgcgggagggcctgcagccggctgtccaccctcatccagcaccagaaggtgcacggccgcgagcccggggaggacacagagggcaggcgggcgccctgttgggcttcctgatgacggggacgacaggccgaggattcacgctggaagcccacccaagccggcggggccctagcgcagaaattcagaaccccctgtcctgaag

SEQ ID NO: 202767 - DNA, 7277 bp, Homo sapiens
  Payload ID: 19993
  Gene Name: zinc finger protein 518A
  Uniprot ID: Q6AHZ1
  ENST ID: ENST00000316045
  CDS Start-End: 858-5309
ggagaccattcccagtcagcaagggcttgggaagtgcatacagttcctgctcctggtgtctactctgaagagcacagagtagacgtttgtctgccatttcaccggcagtaagatcagcagctgctggtgagcaaagaggtagtagtgggtcactggactggtgggcgccggggccgcgcgctagatggagaggtcagcggcgaacccagctccatggcctagtctcgtcagaccgagcgcggaccctgccggcctccgttctcttccgcttgtctcagatatcatctcttcttttgatcactgttcctgattgtgacattgtgcaagtgttaaattgtgtgccttttgttcctgaagaaagagatgtctcctactctttgtgttggataggtcctgggatctttgaaatgctaagattcttggataccacagtatcataaaattcctctaaatgcattggtgctagcaatcccctactctgtctggcctctggatctagcttgaagttctggattcatttccttcttccttgtacctcagcctgagccttctgtcacccaaagggctccagctggtttttcactcaggcctcactttatcttccaagatgaggaaactgaggtccagagaagttgaagttttcccaaggtcacacagcagagctggaactagagcttgcatttcctgacttccagattagtgttatttttacttcaaactattacttcttggtgagttattgtgggaaaaatcctgtatattgaagatgtctctacacagtatcgtttcctgtttaaattacagataacttcaagagttttcagaaaaaaagaaattgggacttttttggttaaatcatgccatctgaacagaaacagttattttgtgatgaaaaacaaactactttaaaaaaagattatgatgtgaaaaatgagatagttgataggtcggcacctaaaccaaaaatttcaggaagtattcattatgcactaaaaaatgtgaaaattgatttgccaaaaataaatattccaaatgaagtcctattgaaacatgaagttgacaaatacagaaaattatttcagagtaaacagcagactgcaagaaaatctatcagtataaagactgtaagctgtgtagaggagtgtacattgcttcataagtctgagagagctgaagaagagggtgtaaaaatgtctgcaaaaatactcaatttcagctgtttaaaatgccgagacaacactcgatatagcccaaatgatttgcagaaacactttcaaatgtggcaccatggcgaattaccttcatatccttgtgaaatgtgcaacttttcagcaaatgactttcaggtatttaaacaacacagacgaacccatagaagcactttagtaaaatgtgacatttgtaacaatgagagtgtatatactttactgaacttgacaaagcatttcacatccacacattgtgttaatggtaattttcaatgtgaaaagtgtaagttctccacccaggatgttggcacatttgttcagcacattcatagacataatgaaattcattataagtgtggtaaatgtcatcatgtatgttttaccaaaggagagcttcagaagcaccttcatattcattctggtacttttcccttcacttgtcaatattgtagctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgacagaagtatagaaaagaacactcaagtgcttaagaaaatgaacaaaacacagactaaatctgaagaccagagccatgttgttcaagagcatttaagtgaagaaaaggatgaaagactacactgtgagaataatgataaagcccctgaatcagagtcagagaagccaactcctctgtccactgggcaaggtaatagagctgaagagggaccaaacgctagttcaggtttcatgaagactgctgtactaggacctacactgaaaaatgtaatgatgaaaaataataaactagcagtttcccctaactataatgctacgtttatgggcttcaagatgatggatggaaaacagcatattgtattaaaattggtgcctatcaaacaaaatgtatgttcaccaggctcacagtcaggtgctgcaaaggacggtactgctaatttgcagccccagactttggacactaatggatttttaacaggagtaacaactgagttaaatgacacagtttatatgaaagcagctactccattttcatgttcatcttctatactttcagggaaagcaagttcagaaaaagaaatgactttgatatctcaaaggaataatatgcttcaaacaatggattatgagaaaagtgtatcttctttgtcagcaacatcagaattggttacagcatcagtgaatttgaccacaaaatttgaaacaagagataatgttgacttctggggaaatcatctcactcagagtcaccccgaggtattaggtaccaccattaaaagtccagataaagtcaactgtgttgccaaaccaaatgcatacaacagtggagatatgcataattattgcattaattatggcaactgtgagttacctgttgaatcctccaaccaaggatcattaccttttcataattactcaaaagtgaataattctaataaacgtcgtaggttttcaggaacagcagtgtatgaaaaccctcaaagagaatcttcatccagcaaaacagttgtccaacaaccaattagtgaatcatttttatcactagtgaggcaggagagctcaaaaccagatagcctattagcatctattagccttttaaatgataaagatggaactttaaaagcaaaatctgaaattgaagaacagtatgttttagaaaaaggacaaaacattgatggacaaaacctgtacagtaatgaaaatcaaaatttagagtgtgcgactgaaaaatctaaatgggaagacttttctaatgtcgattcacctatgatgcctagaatcacatctgttttctctctccagagccaacaggcatcagaatttctgccacctgaagtaaaccaattgcttcaggatgtattgaaaataaaacctgatgtaaaacaagactctagtaacactccaaataaaggcttgccacttcattgtgaccagtcatttcaaaaacacgagagagaaggcaaaattgttgaatcttcgaaagatttcaaagtgcaaggcatcttcccagttccacctggcagtgtgggtattaatgtgcctacaaatgatttgaatttgaaatttggaaaagaaaaacaagtgtcatcaataccacaagatgtgagagattcagagaagatgcctagaatttcaggttttggcacattacttaagactcagtcagatgcgataataacacagcagcttgtaaaagacaaactacgagccaccacacaaaatttaggttctttttatatgcagagtccacttttaaattcagaacaaaaaaaaactataattgttcagacttcaaaaggattcttaataccattgaacattactaacaagcctgggctaccagttattcctggaaatgcacttccattggttaattcacaaggtatccctgcttctctttttgtaaacaagaaacctgggatggttttaacacttaataatgggaaacttgaaggtgtttccgctgtcaaaaccgagggtgccccagctcgtggaactgtgactaaggagccttgcaaaacacctattttgaaggtagaaccaaacaataattgtcttacacctggactttgttccagcattggcagttgtttgagcatgaaaagtagctcagaaaatactttgccattaaaaggcccttacattttgaaaccaacgagttctgtgaaagctgttcttattcctaacatgctatctgagcaacagagcactaagttgaatatctccgattcagtaaaacagcagaatgagatttttccaaaaccacctctttataccttcttgcctgatggcaaacaagctgtttttttaaagtgtgtgatgccaaataaaactgagctgcttaagcccaaattagtccaaaatagtacttatcaaaatatacagccaaagaaacctgaaggaacaccacaaagaatattgctgaaaatttttaaccctgttttaaatgtgactgctgctaataatctgtcagtaagcaactctgcatcctcattgcaaaaagacaacgtaccatctaatcagattataggaggagagcagaaagagccagaatctagagatgccttacccttcttactagatgacttaatgccagcaaatgaaattgtgataacttctactgcaacatgcccagaatcttctgaggaaccaatatgtgtcagtgactgttcagagtccagggtattaaggtgtaaaacaaattgtagaattgagaggaacttcaatagaaaaaagacttccaaaaaaattttttcaaaaacaaaaactcatggaagtaaagactctgaaactgcctttgtatctagaaacagaaactgtaaacgaaagtgtagggatagttaccaagaacctccaagaagaaaagcaacattgcatagaaagtgtaaagaaaaggcaaaacctgaagatgtccgtgaaacatttggatttagcagacctaggctttcaaaagattccatcagaactttgcggcttttcccttttagttctaaacagcttgtgaaatgtcctaggagaaaccaaccagttgtagttttgaatcatcctgacgcagatgcaccagaagtagtaagtgtaatgaaaactattgctaaatttaatggacatgtacttaaggtttcattgtcaaaaagaactataaatgctttactgaaaccagtttgttataaccctcctaaaacaacttatgatgatttttccaagaggcacaaaacatttaaacctgttagttctgtgaaagaaagatttgtgctaaaattaacactcaaaaagacaagcaaaaacaattaccagattgtgaagactacctctgaaaatattttgaaggctaaatttaactgttggttttgtggtagagtatttgacaatcaggatacttgggctggtcatgggcagagacatttaatggaagctactcgggattggaacatgttagaatagtttaccataattaccaaggaaaagaaaagtaaaattaccttagaagaaaacaacgggttcagttaccataatgcagacattttctacttcagtatagtacctgaaatcgaacattttaaaagttgattgtatttctgtggaagagtaaaagttgtatgtatgatatttgaaaatgctatccctgcactcaaaagttttgaaagaaactaatcacagcacagaagtaccttgatttaattttttaaacgtgttctcgggaagttagggctaaagaaaattttgataaaacaattttcccactttagttctttagtgactcttagtagagggtaatggctgacacccccattccctctcttcttccaccagccttatgcatctaagtgtagctcctctggagatggagagctctttcatcgtagaactgaaggagtttctcacatttgtgaagatactttgagagaacctgggtaaagaagtcactctatatctgctaaatatagttattttgaaggatattaggctccttgaaagtacatttaactcactacagttacacctcatacaatgcttgaagagtttttggcaagtaaattttttttccagttgaactctgtcacttgttagagattgggaacactctcccaaggtgattttctttttctaagtgactgtgtcaaatgttgcagtagatgggcagcttcaagagaagaatttaaactctttgtctcattgaaagtttggttaaagaacttgaacatatttctaaatttgattatattctctgatgatccctttgcacagaactatgcttatctcatgtttgtcctccataaacaaatggccatttttttcttcttggttcccatccctttaaaaagagtggaacataggagcacttccaagggagtggcttttcttgaaaattaaaattgtttaccaaaacagtattttgaagcaagatcatatttttgtctgtattcactttattatttgaacatgtccaaattaggacaaagcatttctgttagctgcttctcagtgtgactgacaacccaaaacatatatacagattgttggcatttgcaaaaggaagcatcaatagtggacccagaggcagtgcataaaaccttaggatagattcctaagggacatgcccaacagagttttaaaatggatgttttcatgatgacaacagaatcatagatttagatttttcaccttgtaagtttggatcaaattttgctggttctttggataatggagttcttgtgttaacaaattacgtgctatatgattttttgttacattgttacaagtgttaatgacattttcattaatggatgaaaacttcagggcttcttttctgtatataacaaattaagtctgtacatatttttgtaccttttatgtaaattttgcacagaaatttttggcataagtttattttctttcagtttagttcagtgcatgcactaataaaactggttgtttaatttaaaaggaatatataagactttacccatgttattttcttggtttttatttcagatgtagattttgtttttgaggtaaattcgttcttcagggattgaacactattgttagcaagtgcctaaaaaagatgtgaaacagtttacatatgtcaactgtaacagtaggtcccaaatgggcccattcccctaatagttttatttttaaagaaagccatacatagaatgcttcaagctatcttgctatgcacattatacttgtactgttttgtgcagtttgtctactttcttagtgaagtattttttgtataaaatgttacaattgtgtttcttaaattgagcctaagaatggagttaattggaaatatacagtatatattaataatgtacatggtgtttaaagaatggtaagcattgttaatttctgtaatgaacattttcaattaaatttatcttgtttgtgtttacacaataa

SEQ ID NO: 202768 - DNA, 1579 bp, Homo sapiens
  Payload ID: 19993
  Gene Name: zinc finger protein 518A
  ENST ID: ENST00000478086
  CDS Start-End: 565-1579
aatacccggatggaagtgtaatggccgccatcagggactcgcaggcaatgggtactacgacagatatcatctcttcttttgatcactgttcctgattgtgacattgtgcaagtgttaaattgtgtgccttttgttcctgaagaaagagatgtctcctactctttgtgttggataggtcctgggatctttgaaatgctaagattcttggataccacagtatcataaaattcctctaaatgcaatgaaggaactgagacacagaggttgagacttgtctaaagtaacatgaccagtaagtgcttgaattaatgcagatgaggaaactgaggtccagagaagttgaagttttcccaaggtcacacagcagagctggaactagagcttgcatttcctgacttccagattagtgttatttttacttcaaactattacttcttggtgagttattgtgggaaaaatcctgtatattgaagatgtctctacacagtatcgtttcctgtttaaattacagataacttcaagagttttcagaaaaaaagaaattgggacttttttggttaaatcatgccatctgaacagaaacagttattttgtgatgaaaaacaaactactttaaaaaaagattatgatgtgaaaaatgagatagttgataggtcggcacctaaaccaaaaatttcaggaagtattcattatgcactaaaaaatgtgaaaattgatttgccaaaaataaatattccaaatgaagtcctattgaaacatgaagttgacaaatacagaaaattatttcagagtaaacagcagactgcaagaaaatctatcagtataaagactgtaagctgtgtagaggagtgtacattgcttcataagtctgagagagctgaagaagagggtgtaaaaatgtctgcaaaaatactcaatttcagctgtttaaaatgccgagacaacactcgatatagcccaaatgatttgcagaaacactttcaaatgtggcaccatggcgaattaccttcatatccttgtgaaatgtgcaacttttcagcaaatgactttcaggtatttaaacaacacagacgaacccatagaagcactttagtaaaatgtgacatttgtaacaatgagagtgtatatactttactgaacttgacaaagcatttcacatccacacattgtgttaatggtaattttcaatgtgaaaagtgtaagttctccacccaggatgttggcacatttgttcagcacattcatagacataatgaaattcattataagtgtggtaaatgtcatcatgtatgttttaccaaaggagagcttcagaagcaccttcatattcattctggtacttttcccttcacttgtcaatattgtagctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgaca

SEQ ID NO: 202769 - DNA, 7911 bp, Homo sapiens
  Payload ID: 19993
  Gene Name: zinc finger protein 518A
  Uniprot ID: Q6AHZ1
  ENST ID: ENST00000614149
  CDS Start-End: 482-4933
ctaacagttggtgctagcaatcccctactctgtctggcctctggatctagcttgaagttctggattcatttccttcttccttgtacctcagcctgagccttctgtcacccaaagggctccagctggtttttcactcaggcctcactttatcttccaagatgaaggaactgagacacagaggttgagacttgtctaaagtaacatgaccagtaagtgcttgaattaatgcagatgaggaaactgaggtccagagaagttgaagttttcccaaggtcacacagcagagctggaactagagcttgcatttcctgacttccagattagtgttatttttacttcaaactattacttcttggtgagttattgtgggaaaaatcctgtatattgaagatgtctctacacagtatcgtttcctgtttaaattacagataacttcaagagttttcagaaaaaaagaaattgggacttttttggttaaatcatgccatctgaacagaaacagttattttgtgatgaaaaacaaactactttaaaaaaagattatgatgtgaaaaatgagatagttgataggtcggcacctaaaccaaaaatttcaggaagtattcattatgcactaaaaaatgtgaaaattgatttgccaaaaataaatattccaaatgaagtcctattgaaacatgaagttgacaaatacagaaaattatttcagagtaaacagcagactgcaagaaaatctatcagtataaagactgtaagctgtgtagaggagtgtacattgcttcataagtctgagagagctgaagaagagggtgtaaaaatgtctgcaaaaatactcaatttcagctgtttaaaatgccgagacaacactcgatatagcccaaatgatttgcagaaacactttcaaatgtggcaccatggcgaattaccttcatatccttgtgaaatgtgcaacttttcagcaaatgactttcaggtatttaaacaacacagacgaacccatagaagcactttagtaaaatgtgacatttgtaacaatgagagtgtatatactttactgaacttgacaaagcatttcacatccacacattgtgttaatggtaattttcaatgtgaaaagtgtaagttctccacccaggatgttggcacatttgttcagcacattcatagacataatgaaattcattataagtgtggtaaatgtcatcatgtatgttttaccaaaggagagcttcagaagcaccttcatattcattctggtacttttcccttcacttgtcaatattgtagctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgacagaagtatagaaaagaacactcaagtgcttaagaaaatgaacaaaacacagactaaatctgaagaccagagccatgttgttcaagagcatttaagtgaagaaaaggatgaaagactacactgtgagaataatgataaagcccctgaatcagagtcagagaagccaactcctctgtccactgggcaaggtaatagagctgaagagggaccaaacgctagttcaggtttcatgaagactgctgtactaggacctacactgaaaaatgtaatgatgaaaaataataaactagcagtttcccctaactataatgctacgtttatgggcttcaagatgatggatggaaaacagcatattgtattaaaattggtgcctatcaaacaaaatgtatgttcaccaggctcacagtcaggtgctgcaaaggacggtactgctaatttgcagccccagactttggacactaatggatttttaacaggagtaacaactgagttaaatgacacagtttatatgaaagcagctactccattttcatgttcatcttctatactttcagggaaagcaagttcagaaaaagaaatgactttgatatctcaaaggaataatatgcttcaaacaatggattatgagaaaagtgtatcttctttgtcagcaacatcagaattggttacagcatcagtgaatttgaccacaaaatttgaaacaagagataatgttgacttctggggaaatcatctcactcagagtcaccccgaggtattaggtaccaccattaaaagtccagataaagtcaactgtgttgccaaaccaaatgcatacaacagtggagatatgcataattattgcattaattatggcaactgtgagttacctgttgaatcctccaaccaaggatcattaccttttcataattactcaaaagtgaataattctaataaacgtcgtaggttttcaggaacagcagtgtatgaaaaccctcaaagagaatcttcatccagcaaaacagttgtccaacaaccaattagtgaatcatttttatcactagtgaggcaggagagctcaaaaccagatagcctattagcatctattagccttttaaatgataaagatggaactttaaaagcaaaatctgaaattgaagaacagtatgttttagaaaaaggacaaaacattgatggacaaaacctgtacagtaatgaaaatcaaaatttagagtgtgcgactgaaaaatctaaatgggaagacttttctaatgtcgattcacctatgatgcctagaatcacatctgttttctctctccagagccaacaggcatcagaatttctgccacctgaagtaaaccaattgcttcaggatgtattgaaaataaaacctgatgtaaaacaagactctagtaacactccaaataaaggcttgccacttcattgtgaccagtcatttcaaaaacacgagagagaaggcaaaattgttgaatcttcgaaagatttcaaagtgcaaggcatcttcccagttccacctggcagtgtgggtattaatgtgcctacaaatgatttgaatttgaaatttggaaaagaaaaacaagtgtcatcaataccacaagatgtgagagattcagagaagatgcctagaatttcaggttttggcacattacttaagactcagtcagatgcgataataacacagcagcttgtaaaagacaaactacgagccaccacacaaaatttaggttctttttatatgcagagtccacttttaaattcagaacaaaaaaaaactataattgttcagacttcaaaaggattcttaataccattgaacattactaacaagcctgggctaccagttattcctggaaatgcacttccattggttaattcacaaggtatccctgcttctctttttgtaaacaagaaacctgggatggttttaacacttaataatgggaaacttgaaggtgtttccgctgtcaaaaccgagggtgccccagctcgtggaactgtgactaaggagccttgcaaaacacctattttgaaggtagaaccaaacaataattgtcttacacctggactttgttccagcattggcagttgtttgagcatgaaaagtagctcagaaaatactttgccattaaaaggcccttacattttgaaaccaacgagttctgtgaaagctgttcttattcctaacatgctatctgagcaacagagcactaagttgaatatctccgattcagtaaaacagcagaatgagatttttccaaaaccacctctttataccttcttgcctgatggcaaacaagctgtttttttaaagtgtgtgatgccaaataaaactgagctgcttaagcccaaattagtccaaaatagtacttatcaaaatatacagccaaagaaacctgaaggaacaccacaaagaatattgctgaaaatttttaaccctgttttaaatgtgactgctgctaataatctgtcagtaagcaactctgcatcctcattgcaaaaagacaacgtaccatctaatcagattataggaggagagcagaaagagccagaatctagagatgccttacccttcttactagatgacttaatgccagcaaatgaaattgtgataacttctactgcaacatgcccagaatcttctgaggaaccaatatgtgtcagtgactgttcagagtccagggtattaaggtgtaaaacaaattgtagaattgagaggaacttcaatagaaaaaagacttccaaaaaaattttttcaaaaacaaaaactcatggaagtaaagactctgaaactgcctttgtatctagaaacagaaactgtaaacgaaagtgtagggatagttaccaagaacctccaagaagaaaagcaacattgcatagaaagtgtaaagaaaaggcaaaacctgaagatgtccgtgaaacatttggatttagcagacctaggctttcaaaagattccatcagaactttgcggcttttcccttttagttctaaacagcttgtgaaatgtcctaggagaaaccaaccagttgtagttttgaatcatcctgacgcagatgcaccagaagtagtaagtgtaatgaaaactattgctaaatttaatggacatgtacttaaggtttcattgtcaaaaagaactataaatgctttactgaaaccagtttgttataaccctcctaaaacaacttatgatgatttttccaagaggcacaaaacatttaaacctgttagttctgtgaaagaaagatttgtgctaaaattaacactcaaaaagacaagcaaaaacaattaccagattgtgaagactacctctgaaaatattttgaaggctaaatttaactgttggttttgtggtagagtatttgacaatcaggatacttgggctggtcatgggcagagacatttaatggaagctactcgggattggaacatgttagaatagtttaccataattaccaaggaaaagaaaagtaaaattaccttagaagaaaacaacgggttcagttaccataatgcagacattttctacttcagtatagtacctgaaatcgaacattttaaaagttgattgtatttctgtggaagagtaaaagttgtatgtatgatatttgaaaatgctatccctgcactcaaaagttttgaaagaaactaatcacagcacagaagtaccttgatttaattttttaaacgtgttctcgggaagttagggctaaagaaaattttgataaaacaattttcccactttagttctttagtgactcttagtagagggtaatggctgacacccccattccctctcttcttccaccagccttatgcatctaagtgtagctcctctggagatggagagctctttcatcgtagaactgaaggagtttctcacatttgtgaagatactttgagagaacctgggtaaagaagtcactctatatctgctaaatatagttattttgaaggatattaggctccttgaaagtacatttaactcactacagttacacctcatacaatgcttgaagagtttttggcaagtaaattttttttccagttgaactctgtcacttgttagagattgggaacactctcccaaggtgattttctttttctaagtgactgtgtcaaatgttgcagtagatgggcagcttcaagagaagaatttaaactctttgtctcattgaaagtttggttaaagaacttgaacatatttctaaatttgattatattctctgatgatccctttgcacagaactatgcttatctcatgtttgtcctccataaacaaatggccatttttttcttcttggttcccatccctttaaaaagagtggaacataggagcacttccaagggagtggcttttcttgaaaattaaaattgtttaccaaaacagtattttgaagcaagatcatatttttgtctgtattcactttattatttgaacatgtccaaattaggacaaagcatttctgttagctgcttctcagtgtgactgacaacccaaaacatatatacagattgttggcatttgcaaaaggaagcatcaatagtggacccagaggcagtgcataaaaccttaggatagattcctaagggacatgcccaacagagttttaaaatggatgttttcatgatgacaacagaatcatagatttagatttttcaccttgtaagtttggatcaaattttgctggttctttggataatggagttcttgtgttaacaaattacgtgctatatgattttttgttacattgttacaagtgttaatgacattttcattaatggatgaaaacttcagggcttcttttctgtatataacaaattaagtctgtacatatttttgtaccttttatgtaaattttgcacagaaatttttggcataagtttattttctttcagtttagttcagtgcatgcactaataaaactggttgtttaatttaaaaggaatatataagactttacccatgttattttcttggtttttatttcagatgtagattttgtttttgaggtaaattcgttcttcagggattgaacactattgttagcaagtgcctaaaaaagatgtgaaacagtttacatatgtcaactgtaacagtaggtcccaaatgggcccattcccctaatagttttatttttaaagaaagccatacatagaatgcttcaagctatcttgctatgcacattatacttgtactgttttgtgcagtttgtctactttcttagtgaagtattttttgtataaaatgttacaattgtgtttcttaaattgagcctaagaatggagttaattggaaatatacagtatatattaataatgtacatggtgtttaaagaatggtaagcattgttaatttctgtaatgaacattttcaattaaatttatcttgtttgtgtttacacaataatttttttactgtgctaaaatctgatggaaattttgttctctaggaaatacagattttaaagtgtatgtgttttttcaatgctagttaactctacaagatagataaaagtgtgggattttttttcttcccaaaatcatagatgatatattgtttaagaaaggtaacatataccataattttactatggttatgctggcaaggtgagccatagagaggcttatagtcttcagtaccctaacagcaataaaattaaaatgctctgtttgttacatatagatctgttatgagacatcacctgctgtaaatagcaaggagagagaaggaactttcctgctaatattcgcagcactataacattacatttcagaatagccatatcaggaaaataatgtcgagatatgtacttcttgcctttaagttttaacagccatttaaagtaagctttgtgctccagatattctagttggaactttttctgattttgttaacttaagttattctgagggaggcagacctgcttagagtttcattattgccattgcagaaaatccaaaacaaaagcctgtatcctttattttttgtgtgtggctttccaaagagggctttccaaaatatgattttcagtagttcgaggttcttattacaattgaagagttagttttagttttgcagttgaatttctgtgtgaggaatttgttttattttttctagtttgtccatctccactgaaatgggtttcttactatttggcaagtacttaaaaaacataattcagttttcaaagaatttatcttgctaagtattcagtaacacaaattgaaatgtaatagtttttttaatggaaaatattttcattggggggttagcaaattttttcaataaagggtcagataaataagcttcgtaggccttctagtttctgtcctaactactcaattctcataatgcagaaaaaaaccatagacaatatgtaaatgaattagtgtggctatgttttaataaaacaattt

SEQ ID NO: 202770 - DNA, 7994 bp, Homo sapiens
  Payload ID: 19993
  Gene Name: zinc finger protein 518A
  Uniprot ID: Q6AHZ1
  ENST ID: ENST00000624776
  CDS Start-End: 565-5016
aatacccggatggaagtgtaatggccgccatcagggactcgcaggcaatgggtactacgacagatatcatctcttcttttgatcactgttcctgattgtgacattgtgcaagtgttaaattgtgtgccttttgttcctgaagaaagagatgtctcctactctttgtgttggataggtcctgggatctttgaaatgctaagattcttggataccacagtatcataaaattcctctaaatgcaatgaaggaactgagacacagaggttgagacttgtctaaagtaacatgaccagtaagtgcttgaattaatgcagatgaggaaactgaggtccagagaagttgaagttttcccaaggtcacacagcagagctggaactagagcttgcatttcctgacttccagattagtgttatttttacttcaaactattacttcttggtgagttattgtgggaaaaatcctgtatattgaagatgtctctacacagtatcgtttcctgtttaaattacagataacttcaagagttttcagaaaaaaagaaattgggacttttttggttaaatcatgccatctgaacagaaacagttattttgtgatgaaaaacaaactactttaaaaaaagattatgatgtgaaaaatgagatagttgataggtcggcacctaaaccaaaaatttcaggaagtattcattatgcactaaaaaatgtgaaaattgatttgccaaaaataaatattccaaatgaagtcctattgaaacatgaagttgacaaatacagaaaattatttcagagtaaacagcagactgcaagaaaatctatcagtataaagactgtaagctgtgtagaggagtgtacattgcttcataagtctgagagagctgaagaagagggtgtaaaaatgtctgcaaaaatactcaatttcagctgtttaaaatgccgagacaacactcgatatagcccaaatgatttgcagaaacactttcaaatgtggcaccatggcgaattaccttcatatccttgtgaaatgtgcaacttttcagcaaatgactttcaggtatttaaacaacacagacgaacccatagaagcactttagtaaaatgtgacatttgtaacaatgagagtgtatatactttactgaacttgacaaagcatttcacatccacacattgtgttaatggtaattttcaatgtgaaaagtgtaagttctccacccaggatgttggcacatttgttcagcacattcatagacataatgaaattcattataagtgtggtaaatgtcatcatgtatgttttaccaaaggagagcttcagaagcaccttcatattcattctggtacttttcccttcacttgtcaatattgtagctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgacagaagtatagaaaagaacactcaagtgcttaagaaaatgaacaaaacacagactaaatctgaagaccagagccatgttgttcaagagcatttaagtgaagaaaaggatgaaagactacactgtgagaataatgataaagcccctgaatcagagtcagagaagccaactcctctgtccactgggcaaggtaatagagctgaagagggaccaaacgctagttcaggtttcatgaagactgctgtactaggacctacactgaaaaatgtaatgatgaaaaataataaactagcagtttcccctaactataatgctacgtttatgggcttcaagatgatggatggaaaacagcatattgtattaaaattggtgcctatcaaacaaaatgtatgttcaccaggctcacagtcaggtgctgcaaaggacggtactgctaatttgcagccccagactttggacactaatggatttttaacaggagtaacaactgagttaaatgacacagtttatatgaaagcagctactccattttcatgttcatcttctatactttcagggaaagcaagttcagaaaaagaaatgactttgatatctcaaaggaataatatgcttcaaacaatggattatgagaaaagtgtatcttctttgtcagcaacatcagaattggttacagcatcagtgaatttgaccacaaaatttgaaacaagagataatgttgacttctggggaaatcatctcactcagagtcaccccgaggtattaggtaccaccattaaaagtccagataaagtcaactgtgttgccaaaccaaatgcatacaacagtggagatatgcataattattgcattaattatggcaactgtgagttacctgttgaatcctccaaccaaggatcattaccttttcataattactcaaaagtgaataattctaataaacgtcgtaggttttcaggaacagcagtgtatgaaaaccctcaaagagaatcttcatccagcaaaacagttgtccaacaaccaattagtgaatcatttttatcactagtgaggcaggagagctcaaaaccagatagcctattagcatctattagccttttaaatgataaagatggaactttaaaagcaaaatctgaaattgaagaacagtatgttttagaaaaaggacaaaacattgatggacaaaacctgtacagtaatgaaaatcaaaatttagagtgtgcgactgaaaaatctaaatgggaagacttttctaatgtcgattcacctatgatgcctagaatcacatctgttttctctctccagagccaacaggcatcagaatttctgccacctgaagtaaaccaattgcttcaggatgtattgaaaataaaacctgatgtaaaacaagactctagtaacactccaaataaaggcttgccacttcattgtgaccagtcatttcaaaaacacgagagagaaggcaaaattgttgaatcttcgaaagatttcaaagtgcaaggcatcttcccagttccacctggcagtgtgggtattaatgtgcctacaaatgatttgaatttgaaatttggaaaagaaaaacaagtgtcatcaataccacaagatgtgagagattcagagaagatgcctagaatttcaggttttggcacattacttaagactcagtcagatgcgataataacacagcagcttgtaaaagacaaactacgagccaccacacaaaatttaggttctttttatatgcagagtccacttttaaattcagaacaaaaaaaaactataattgttcagacttcaaaaggattcttaataccattgaacattactaacaagcctgggctaccagttattcctggaaatgcacttccattggttaattcacaaggtatccctgcttctctttttgtaaacaagaaacctgggatggttttaacacttaataatgggaaacttgaaggtgtttccgctgtcaaaaccgagggtgccccagctcgtggaactgtgactaaggagccttgcaaaacacctattttgaaggtagaaccaaacaataattgtcttacacctggactttgttccagcattggcagttgtttgagcatgaaaagtagctcagaaaatactttgccattaaaaggcccttacattttgaaaccaacgagttctgtgaaagctgttcttattcctaacatgctatctgagcaacagagcactaagttgaatatctccgattcagtaaaacagcagaatgagatttttccaaaaccacctctttataccttcttgcctgatggcaaacaagctgtttttttaaagtgtgtgatgccaaataaaactgagctgcttaagcccaaattagtccaaaatagtacttatcaaaatatacagccaaagaaacctgaaggaacaccacaaagaatattgctgaaaatttttaaccctgttttaaatgtgactgctgctaataatctgtcagtaagcaactctgcatcctcattgcaaaaagacaacgtaccatctaatcagattataggaggagagcagaaagagccagaatctagagatgccttacccttcttactagatgacttaatgccagcaaatgaaattgtgataacttctactgcaacatgcccagaatcttctgaggaaccaatatgtgtcagtgactgttcagagtccagggtattaaggtgtaaaacaaattgtagaattgagaggaacttcaatagaaaaaagacttccaaaaaaattttttcaaaaacaaaaactcatggaagtaaagactctgaaactgcctttgtatctagaaacagaaactgtaaacgaaagtgtagggatagttaccaagaacctccaagaagaaaagcaacattgcatagaaagtgtaaagaaaaggcaaaacctgaagatgtccgtgaaacatttggatttagcagacctaggctttcaaaagattccatcagaactttgcggcttttcccttttagttctaaacagcttgtgaaatgtcctaggagaaaccaaccagttgtagttttgaatcatcctgacgcagatgcaccagaagtagtaagtgtaatgaaaactattgctaaatttaatggacatgtacttaaggtttcattgtcaaaaagaactataaatgctttactgaaaccagtttgttataaccctcctaaaacaacttatgatgatttttccaagaggcacaaaacatttaaacctgttagttctgtgaaagaaagatttgtgctaaaattaacactcaaaaagacaagcaaaaacaattaccagattgtgaagactacctctgaaaatattttgaaggctaaatttaactgttggttttgtggtagagtatttgacaatcaggatacttgggctggtcatgggcagagacatttaatggaagctactcgggattggaacatgttagaatagtttaccataattaccaaggaaaagaaaagtaaaattaccttagaagaaaacaacgggttcagttaccataatgcagacattttctacttcagtatagtacctgaaatcgaacattttaaaagttgattgtatttctgtggaagagtaaaagttgtatgtatgatatttgaaaatgctatccctgcactcaaaagttttgaaagaaactaatcacagcacagaagtaccttgatttaattttttaaacgtgttctcgggaagttagggctaaagaaaattttgataaaacaattttcccactttagttctttagtgactcttagtagagggtaatggctgacacccccattccctctcttcttccaccagccttatgcatctaagtgtagctcctctggagatggagagctctttcatcgtagaactgaaggagtttctcacatttgtgaagatactttgagagaacctgggtaaagaagtcactctatatctgctaaatatagttattttgaaggatattaggctccttgaaagtacatttaactcactacagttacacctcatacaatgcttgaagagtttttggcaagtaaattttttttccagttgaactctgtcacttgttagagattgggaacactctcccaaggtgattttctttttctaagtgactgtgtcaaatgttgcagtagatgggcagcttcaagagaagaatttaaactctttgtctcattgaaagtttggttaaagaacttgaacatatttctaaatttgattatattctctgatgatccctttgcacagaactatgcttatctcatgtttgtcctccataaacaaatggccatttttttcttcttggttcccatccctttaaaaagagtggaacataggagcacttccaagggagtggcttttcttgaaaattaaaattgtttaccaaaacagtattttgaagcaagatcatatttttgtctgtattcactttattatttgaacatgtccaaattaggacaaagcatttctgttagctgcttctcagtgtgactgacaacccaaaacatatatacagattgttggcatttgcaaaaggaagcatcaatagtggacccagaggcagtgcataaaaccttaggatagattcctaagggacatgcccaacagagttttaaaatggatgttttcatgatgacaacagaatcatagatttagatttttcaccttgtaagtttggatcaaattttgctggttctttggataatggagttcttgtgttaacaaattacgtgctatatgattttttgttacattgttacaagtgttaatgacattttcattaatggatgaaaacttcagggcttcttttctgtatataacaaattaagtctgtacatatttttgtaccttttatgtaaattttgcacagaaatttttggcataagtttattttctttcagtttagttcagtgcatgcactaataaaactggttgtttaatttaaaaggaatatataagactttacccatgttattttcttggtttttatttcagatgtagattttgtttttgaggtaaattcgttcttcagggattgaacactattgttagcaagtgcctaaaaaagatgtgaaacagtttacatatgtcaactgtaacagtaggtcccaaatgggcccattcccctaatagttttatttttaaagaaagccatacatagaatgcttcaagctatcttgctatgcacattatacttgtactgttttgtgcagtttgtctactttcttagtgaagtattttttgtataaaatgttacaattgtgtttcttaaattgagcctaagaatggagttaattggaaatatacagtatatattaataatgtacatggtgtttaaagaatggtaagcattgttaatttctgtaatgaacattttcaattaaatttatcttgtttgtgtttacacaataatttttttactgtgctaaaatctgatggaaattttgttctctaggaaatacagattttaaagtgtatgtgttttttcaatgctagttaactctacaagatagataaaagtgtgggattttttttcttcccaaaatcatagatgatatattgtttaagaaaggtaacatataccataattttactatggttatgctggcaaggtgagccatagagaggcttatagtcttcagtaccctaacagcaataaaattaaaatgctctgtttgttacatatagatctgttatgagacatcacctgctgtaaatagcaaggagagagaaggaactttcctgctaatattcgcagcactataacattacatttcagaatagccatatcaggaaaataatgtcgagatatgtacttcttgcctttaagttttaacagccatttaaagtaagctttgtgctccagatattctagttggaactttttctgattttgttaacttaagttattctgagggaggcagacctgcttagagtttcattattgccattgcagaaaatccaaaacaaaagcctgtatcctttattttttgtgtgtggctttccaaagagggctttccaaaatatgattttcagtagttcgaggttcttattacaattgaagagttagttttagttttgcagttgaatttctgtgtgaggaatttgttttattttttctagtttgtccatctccactgaaatgggtttcttactatttggcaagtacttaaaaaacataattcagttttcaaagaatttatcttgctaagtattcagtaacacaaattgaaatgtaatagtttttttaatggaaaatattttcattggggggttagcaaattttttcaataaagggtcagataaataagcttcgtaggccttctagtttctgtcctaactactcaattctcataatgcagaaaaaaaccatagacaatatgtaaatgaattagtgtggctatgttttaataaaacaattt

SEQ ID NO: 202771 - DNA, 6894 bp, Homo sapiens
  Payload ID: 19994
  Gene Name: zinc finger protein 518B
  Uniprot ID: Q9C0D4
  ENST ID: ENST00000326756
  CDS Start-End: 440-3664
gacgccccttcgccgggacctggcacccgaatccggcctgccgggcctctttgtgcagcgccttgctgacgcccagggttctgatgtagaagcctacaccagggcctgaggttgtgaaactcatggcagtccacgcctgagaagagaaggcctgaaagagaaggaagagcccatgggacttgccacggttttgacttacatctgcaactccaaggctacaggcaggaatgttacctggaatgtcagagagctgaaagcagtcatattttgggatcatgcacctactgcggcagtatataaagaaagataattaagtatgcacccaagaagtagctgcgcccctacccatcacaaactgtatagaaggatatctcctaaggattttatcatgtgaaaactttctgaattttagttggctctttttagaaatgcagataagatgaaggatattggacagcagctatacactacacacttgaacggcggacataattccttgaccatgtcacccaaacagcctgatgctaatggagcacctcggccaaatagacaagaagcacaaacccttttgtatcaaggctcagaggcagaggctgccatgatgaccattgctacatgtgcaaagtgcaaaagtgttcacaagatctctcttcaagatttgcagaagggtacagggaaggacggtatgtatgtctgcttccagtgcagcctcggtgcagctcctcccaattttcattttgtgagcaataattccagtgcgactcatgttggaaataaaactgaaaacttctcaagttctgtcaatagcaaatttaaggtaaggaactttaagccaggcaaatactattgtgataaatgtcgattctctacaaaggacccgctgcagtacaaaaagcacacccttcaacacgaggagattaaattcatttgttctcactgcagctacatttcgtatacgaaaggagagtttcagaggcatttggtgaaacacacaggcatatttccttatcagtgtgagtattgtgactatggtgctattagaaatgattatattgtcaaacacacgaagagagtacatgaaagggcaggtgcgaaacggccagtcaaagctgttgccaagctggagccaaaaagaaccggaacttcaaaacaaaacccagagcttctaaaagcttccaatccacggactacatttcaaaataagtggtcagaccaactgtcaggtttctctctccatgcaaataaagacaaaatgcacaatatcatgttgttacctgaaccaaaggaataccaaaaagatgtagtttgtattccaaataaaatgaccctgtctgagccaaatgaagtcaacctatttgagaacaaaaatgttgaagtagaagtgttatcccctgcaaaagaacctgttcagccaggtatgccattgacagttgttgcaccagcagaactagttgtccctgcaaactgtttagcccagttgatagatgtgaaggttgtcaatggtacacagcagcttgttctgaaactgtttccgctggaagaaaataattgccttgaagctgggagggataatggaggtaattctgaacgtatggtgaaagagaagggttcaaatgaacaagaaaaagtactttctgcagaaaaaacaaagtcactgacagttgacgggaatgttggaaaactcgtaggcattgatagttttcaaccttcagttcagaaacagcttaaaaatgtgaaatgggtaaggtcttatgattttattatgccaaattctagtgtgcacaacaatggaaaatccttcattaattcggaaacaattgaggattttcagaaaaaaaataatttgtatccacatagaactgcttttccttccgttgccttaaaaggtcattctctagcatctgtatttaaaaacagtgttttacgtagtcttggagctgcatcaaacccttttccatataaagctgctgtttgttttgctgaaagtggaagaaatttacacagtagctcacagcagttactcccatttgctgcatcacctgcaacctgttccttctctggagaaaagggcttattgcctgtaagtgaaaatgacttggaatctacaagtaaagtcaatattcctgtaaaagtggtttcctctaataggaagcaggaagataaccagacagaggaacacaaggcagtttcaactgtaggccagatttcctctcaacataagagtgagtatttacatataaacataactggagaagatagatctcaacagcctggggataagcctttggaattaaagaattctgaaaggactaacaacactaatgatggcccagtcatctcatcagtattttctctgagctctggatctgaaaatgtccccgagggcattaagtggaatagctcaacgtctaaaataaagtcaattgaactgttgcgcagaaagatagctcagttaattgagtcctgtgggaagccgtcatctttggcttcaaatagtgcacatcgtcgctctgtagggcaggcatcaaagggaacttcaaaagctacctctgaaggtattcaagaaatcaacgtgtcactcactggtcttggccattccacaggtactcttcagaaacctccgaatgatggtggtattactggtaatagacagcttactcatcaacaaatatatccacactttgcagatggcagtaataggaaaaccaaaagcagagtggccaggaaggctcatgttgccacgccagtgttaatccccaaaggggctgtgttgagggttcttaattcctctgagaatgcccacatcatagaggctacatgtgaagcacctgtcagcataccttgcagtgaaagacagttaataaaaccagttccattttgccctgtgagacaggcggactcagacttacagcctttaagaagtgaaagggggccaatagatatgtccccaaatatcgagacacctctgcggcctaaactgagaaaagagagtgctgtctgtagcaccatccatagaaaaactggcctcttgtatggacagcaaggaagcagtgaattaaataagcaagggagactgctttccagaagtctttctataagtagaaataaaaccaaacaagtacacttatccaggaagaaaaacaaaattcaagctgaacctagccgctgtctcaaggatccttcaatttttcaggttgcaaggcaactaagactgatagcagctaagccagatcagttgattaagtgtccccgtcggaaccagccagtcattgtgttaaaccaccctgatgtggactcgccagaagtgaccaatgtgatgaaggtaataaataaatacaaaggcaatgtcctcaaagttgttttatcagagaggactaggtgtcagctaggcatcagacggcatcatgtacgcctgacctaccagaatgcggaagaagccagtcaaattaaaaggcaaatgatgttgaaaatgaaactcaaaaaagttcataaaaacaactaccaggtagtggattccttgcctgatgattcttcacagtgtgtatttaagtgctggttttgtgggcgactgtatgaagaccaggaagagtggatgagtcatggccaacggcatttgatagaagcaactagagattgggatgttctttcctccaagggcaaataagtaaacagttactctttaaagcaagttatcttttagtttattctggtttggagtccctccaccaagattcagtagaagaaatacagactgtagaaatgagaggactgctaattcttcagaactgtaggaatattgggagctaggagtctgaacctgaagtatgtgattggaccccagaatgtatttgaaggctctgaaattgtacatgcaaattggtacatatgcatttttctggagagagcctgtgaaactgaacagattttcagtgggatctgagacttttctttgtttagcaccccgttttctgagtacatactgatctttcataatccattcagaggggcagattgagaatgttttacacatgctcttcatataaatgctacagaaaaacctttgttttggtgtgcacatccattttgtttttgctttaatttgtgttctgagtatttggtgcacaatggaaattatattttctactttactgtcttcaatttggttatagagaaatggccattcttttactccctccctggttttgtaatactcccgagtgttccgtatagcacaaagagttttgcttttactggccattttaaagaatgttttcaactgcttgcctgaatttactcctttcacagcaagtgttagaagaaagataacattttcaaatacttagcttttgctttctttaaaatacattggtttatgacatatgggaagggaacgtacctttttgcaaagacaaaaagagattacaaaaggaaaatatctaaaactattttctctttgcccttaccactcccagaaacataagtgaccaatttaaaatgctagggaacaggcttacaacataggtaaaactcgcaaacacagttcaaggtaggctcataaagttgtgaaaagggtttcatatgccctttagttttcatttgggattcatccaaagaccatgggtggatgctgtcttctctcttcttgatccctttgattcatggacactagactccctttgccatttcttctgaaccggccctcctgtggactagcacaacttccttgcccactgtttcttcctttctgtgcctttgagaccccttaaggttttccctcatgcgattactagaaaatggcaggaatcaacaaaatggagacctcccactgtttttgctaaagttacaggaacacgatccctagttttcattgatagtaacgctgtttctaatttgtcttaaccacattcatgcttaccctgctgctcagctttctcagggaagcaactccaggaacactccttccactcccctctctaccaacagatgtcaggactgtcatttatctacacatttgtgttctttagaaaaaggcccaccccctgcacaagcacagcctcttgggcagataggtggctgggtcagtgcttaagacaggattctagtcttcacttgcctgtgcagctgggcgctgaccttccaggtagagcacagatggcacaaccccgaggcagccccaacttgcatttccctccctccaggggctattcctgtcttaggcgatttgtggggtgcagtgaatgaaactaaagagttgttgcacctgaaaaagacaccagtgattgtttattgggtagtcgattggagactttgatttttttttttttttttcacatgggaaagtcttagattccagtagatggaattgcaatcctttgcagtttgttctcattacagataatcaacatttcttttgtataattcaatacatgatcatcaagttaattggtaaatttttattgaaatttaaaacttgcatttttatatatgtgtatgtgtacacataaaaatattttttaccatatgaaaattgcagtagctaattttctgatttcctattttataatgatacatgggctggaaaaatgtagaacgtttttatattctagaaatttattttggaagtacatttttataagggtctaatctcacttttggaaaatgaaagcacaggaatgatggggtctggtttatgtgaacaagtgagtagaaacccctttggatcattttattactgcatttttatttggtgctttttaggaagtagatctttggtaccacttcactacgtagagcattcgaagttttatccatgttatatattgtactcctgtggcatgaaaaatagctcccaagatatagagaggagaggagtgaagaaaaggctgtggtttttttttgttttgttttgtttgccacttttttatctcctattcctcaccacatagtgctttttcctgaaaagctggactgagaattggccttgaatcaggtcagagtgttaactgtcaacatgaagtattttcacttcgcagcatcaactttcaagcataagtaaaaacacaacttgcatactttgatggagcttaattgtgtgagtagaatatgtagcaaagctttttaggattttcagaactagaatactttttaaggaattaaaagtgtttctggaagtcaaaaatgggaaagcaaaaagtagctgtcctccctaaagagctttagaagatagcttaacctgtaggtacatgttatgaaataaacacatttctaacaatacaagggagtaggggcagacctgtgttgagtatttgtgtgggttcttaattttgaaggacctccaatcactacattttgttaatactgccaataaaatcattttcaacttattttttaaagtaggttttcttactttggtggaccagaagtgagagattgttatatttaggatataggcaaatacagtaaaagttaaaaaaaaaaaacctgacccaaagtatactctgatagactatattatattcaattttgtatccccagtcgagaacatcttgtaagccttcattaagggccacctgctgtctgttgaactagactgaacaaaatatattttctcacaagctccatccctttttctttaggacatgttatatataatccatctcagaagttgaagatgtgatgttgctcggcctttggaataatttttaaatctgtaaatgtctatatgagcagaaacaaaacattgtgtaacatgttttaagcattattgtaattcctgtgttaacagtttgtgtgtctgctgctctggttttgaaacatgtttgtatatagatacaggagttggcataaattttgttaaataaagcaacaaaaattttctttgccctttgatttcaa

SEQ ID NO: 202772 - DNA, 527 bp, Homo sapiens
  Payload ID: 19994
  Gene Name: zinc finger protein 518B
  ENST ID: ENST00000507515
  CDS Start-End: 301-527
gacctacagcgggcgcggcgccggcggtctgcggccggcggtgtagacgccccttcgccgggacctggcacccgaatccggcctgccggtgttacctggaatgtcagagagctgaaagcagtcatattttgggatcatgcacctactgcggcagtatataaagaaagataattaagtatgcacccaagaagtagctgcgcccctacccatcacaaactgtatagaaggatatctcctaaggattttatcatgtgaaaactttctgaattttagttggctctttttagaaatgcagataagatgaaggatattggacagcagctatacactacacacttgaacggcggacataattccttgaccatgtcacccaaacagcctgatgctaatggagcacctcggccaaatagacaagaagcacaaacccttttgtatcaaggctcagaggcagaggctgccatgatgaccattgctacatgtgcaaagtgcaaaagtgttcacaagatctctcttcaagatttgcagaa

SEQ ID NO: 202773 - DNA, 2830 bp, Homo sapiens
  Payload ID: 19995
  Gene Name: zinc finger protein 519
  Uniprot ID: Q8TB69
  ENST ID: ENST00000590202
  CDS Start-End: 154-1776
cacttcagccagagcgcggggttagggcttcattgccttgtgtcctctgctccgggagacttcggtgattctgccactcactccgtcgctctgtgacctgctggcattgaatgatttatagctaagactccaggacacccctgaagccgagaaatggaactcttaacattcagggatgtggccatagaattctctccagaagagtggaaatgcctagaccctgcccaacagaatttatatagagatgtgatgttggagaactacagaaacctcgtctccctggctgtgtattcttattacaaccaaggcattttaccagagcaaggcatacaagattcattcaaaaaagcaacactgggaagatatgggagctgtggccttgaaaatatatgcttatggaaaaactgggaaagtataggtgaaggtgaaggacaaaaggaatgttataatctatgtagccaatatttgacaactagtcataacaaacatttaactgtgaaaggagacaaagaatatagaatatttcagaagaagcctcagtttctgtcagctgctcctacagaaccatgtattcctatgaataaatatcaacataaatttttgaaatctgtcttttgtaataaaaatcagataaattttaaccatgactcaaatattagtaaacatcatagtactcattttctagaaaactattacaattgtaatgaatgtgaaaaagtattttaccaatcctcaaagcttattttccctgaaaatatccatattcaaaaaaagccttacaactctaatgaatgtggtgaaacttctgacccattctcaaagcttactcaacatcaaagaatttatattggagagagctcacaaagatgtaataaaaaatgtataatagtctttagtcaatcacatctaaagggacataagataattaacactggagaaaaatcagtgaaatataaagaacgtggcaaagcttttaccaggggcttacatcttggacatcagaaaattcatactggagagaaaccttacaaatgtaaaaaatgtgacaaagcctttaacaagagttcacaccttgctcaacatcagagaatccatactggagagaagcctttcaagtgtaaggaatgtggcaaagcttttaacagaggctcataccttactcaacatcagagaatccatactggagagagagctttcaaatgtgaagaatgtggcaaagcctttaacagggggtcataccttactcaacaccagagaatccataccggagagaaacctttcagatgtaaggaatgtggcaaagcctttaatagaagctcatacgttactcagcatcagagaatgcatactggagagaaacctttcaagtgtaaggaatgtggcaaagcttttaacagagcttcacaccttactcaacatcagagaatccatactggagagaaacacttcaaatgtaaagaatgtggcaaagcctttaacaggggctcacaccttactcgacatcaaagaatccatactggagagaagtctttcaaatgtgaagaatgtggcaaagcttttatctggggctcacaccttactcaacatcagagagtccatactggagagaaattcttcaaatgtaaagaatgtggcaaagcttttaccaggagctcacaccttactcaacatcagagaattcatactggagagaaacctttcaaatgtaaagaatgtggcaaagcttttaacagacgctcaacccttactcaacatcaaataattcataccaggtagaaaccctgcaagtgtaaagaatgtgctaaaaccctaaactggtgctcacaccttactcaacattagaaaatcaatactggatagaaatcccatatgtgtaatgatttttgaaacatcaaaatgaagattaaataaaaattagaagtgtcactttagaaagaactaaggtgctagcacttccgtaaattactctgaatcagtgtgtttattataacaaataattcaaactcaattagataattaaattgtatgtttaaaaagagggacgacattgatggagaggcataattatattcaatgttcacttatttttgtaatcacagtattcatgattgagaaagtattattgatgtaattaaattcaaattaaccttttttttccccactgtggttgattattgctgtctctgacatgagagtcccttctacgttaggtaggcatcattcacatgtctcattcacatgtcatcattcacatgtctcatgacgtcattcacaagtttcccatggaagactaagagcattggcatataggatgtatgatgaaatctaaatggagttgctctttttgtttgacttacaacactgaatataagtcatatatgagttaggtgttcagaatattattgttctgcattaaagtgtgagacagaaacactctgagttttagatatgaatagttttaccaactacccattaaaaggtcttgctagtccattaatattctaatgtatcttcatagcagcaagttagaagtcctgaatgttactgtgataacaataaagaaatcacaaatatcagagagtggtgcaaataacttctctctggtagaacatagattattaattcaatcctctaaatacttaggctcagtttaagaaaagagagaacacatttttttaacataggtcatggtatcagaataagaatgctttttgaatgtttgcagtctgtaattttgatgattgaggaaactggattttgaaatgctttattcagtctgtaaacttaatttttttttaagaataaaatgaaatgtcttttaatttgttaa

SEQ ID NO: 202774 - DNA, 2117 bp, Homo sapiens
  Payload ID: 19995
  Gene Name: zinc finger protein 519
  ENST ID: ENST00000589498
  CDS Start-End: 152-394
cttcagccagagcgcggggttagggcttcattgccttgtgtcctctgctccgggagacttcggtgattctgccactcactccgtcgctctgtgacctgctggcattgaatgatttatagctaagactccaggacacccctgaagccgagaaatggaactcttaacattcagggatgtggccatagaattctctccagaagagtggaaatgcctagaccctgcccaacagaatttatatagagatgtgatgttggagaactacagaaacctcgtctccctggagctccacacagaacatcatcaaagaactgatggacacttcatctccctgggtgaggggcaggtgtaccatgctgtcatggccattcctgcctcgattggggtgtgggtgtagagatggtctctataaccagggcccagacatggctgagaaggccttctgccaggactccaccttgatgactcacaggactttgtgccttggctttccctattgagtgacccacagttttaatccaagggaccctgagtctgtttccttccttcagccccaccatttcaccccagcactgttcaggtgtacaatcggctttcacatatttgtaagaatatctaggaaaattatttatattttactttcacttcatgttatgaccatgagtgtttttgcatttgctagggctcattgttttaattggcccccctttatccctctgagtgcggaaataaatcagccctaaatctggatgagacctgcaggtggactccatcagtgcaggcgtggtggggcagcaggaggagcccgtggtgcccaccttccagagctgccacctcttttacctcctcatgttccttcctgtgcacctagagagagttcacccccacccaacagctcctggacctgctgcccaaaaggtaagtgctccatccctccacagcacaagggggactcagccacctattatctgtgtcttgggaaagtcccttcacatttgtgggcttcagtttgcttctttggaactggggttctaagaagcctaacatgatatgattgtttcaagaactaaatgagataagctatggaaagtacttcagacttggccttgtagaaagcactgctgagggaatagattggttattcatattataaaactatttaaaactctagaaaactatagtaagatataagattataaaaatatcaaaactaagatattgacagtaatagaattaacctactcatctatttgcattttaccagattaattttttcttatgtgtgtgtgttctgtgcaattttattacatgtgtaggttcacctaccagaagattaactcgttttcctcttataaccacatccgcttcccttctccccaccatacccactctgattctgattctttgaaaccattaatttctatttctgcaaatttgtcattccaataatgttatataaatgaaatcataacctgtgcaaccttttgtaattggcccttttccttcagcataattccttggagattcatctaaattggtttatgttttagtttgttccttttgttattgctgtgggttttcatgtgtggatgttaccatgaaatactgtgtgtaacccttcactctttcaagaacatatttgttgttttcagtcagtgtgtggctattatgaataaaagtgctatgtacattcatgtactaggtttcatatgaatacatgttttcattactctggaaaatatttccagcatacaattcctggctcatagggtagttacaagtttaattttaatagaaactagcactctgttatccagagtgactatcattttacattcccatcatcaatgaatttctgttttttcaaatcctcttagccatactgactgatatgtattgatatcacattgttttaatgtacatttttctaaaggataataatgttgaactttatttaatgttctcatatgacatctgcctattatctctgatgaaatgtttattcatgtctgcatgttttctaattgtatttgttttcttgcaagttttgagagttctgtttatattctggttactagctcacataggcaataaataagttttttttccacaaagaaaaa

SEQ ID NO: 202775 - DNA, 2114 bp, Homo sapiens
  Payload ID: 19995
  Gene Name: zinc finger protein 519
  ENST ID: ENST00000587419
  CDS Start-End: 153-305
acttcagccagagcgcggggttagggcttcattgccttgtgtcctctgctccgggagacttcggtgattctgccactcactccgtcgctctgtgacctgctggcattgaatgatttatagctaagactccaggacacccctgaagccgagaaatggaactcttaacattcagggatgtggccatagaattctctccagaagagtggaaatgcctagaccctgcccaacagaatttatatagagatgtgatgttggagaactacagaaacctcgtctccctggtggaaaagcgagattgtctttgaccatttgctatggacattgtcagggatggtgcagcctgaatgagaatgtctgcggtatttcccgaaataagtatccctcaaggatgatactgtggacctcactcaggaagaatgtgtccttcagggaaagctgcacagagacgtgatgctggagaagcagtcatctggttactttagtacatgacttcaggctcctatgtgcagaagtcctcaacccccaggctgcagaccagtacctgtccatggcctgttaggaaactggccgcacagcaggaggtgaaatgattattgcagtttcgaggggagatgatgtcacaagatctcgaacccatatctcagaaccgcctgcctcctcccacacactctggctgtcctgaccatcacttcaagcccaccagccctgcagcaaaaaaaatcaaacgagtagttcagaaggcaaagtctgcaagggaaggaagtatattgggaggtacagtaagtattcctgtctggagaaggtcttctttggggctagaaactgagccagtgctaaagccatgcaggaaggaggaaataatcagtgagccacgggctgaacttgtggaaaagaaatggagggcaaggtcacaaaccagtccctaactgcttctaatttaatgtaatcctcactgtttgtcattattgcttttgatggccatgaaatctgttttttcccagttctctagtgtaatttggaattaatttcccagctgctttattttttttctagaagagtcggggacattttcaggattagtagaggtgtttctacaacaccttcatgccttcgatagtgtgtaagagttcaccaattgaattaccttattctgttcagaagtagtaactatggagtttaaccactctggacatattatatacttaatggagaccatagctgtgtggtgactgaaaacatgcattgtctactccttatggtgagactgctttccttcatgaagtcagtaaagaagggtaacttttctgtagatttttgtatttttaaaaaaggtcaagatcttcggcagttttctgaattgaattgtttgtgatatttgctctgtttttaaaatcttctaaggccattaccaggttcagtgcttatcttagtacaatttaaattgattccgtgaataatttttcctgcctccagtttcccttttacatagtgggctcatgttttaatatgttaaacaattctgacattgaaataattttattttatatttttgcatccacaaatactaattttctccatatattaatggtgatgtagtttctcctctgcaatattttattgcctactcatgttttatgtcccctggattacagcactgtcattccactgtgccctatttcttggttatgatgaaaagactcttaattccagtatgaaatcatttctgcattccataaatttcatttggcatctgtggaattaaggcatcttcattgtatttggatctctgaatcataagtgatatttgcctataaattaagcaatgatatttaaataagagattaccacaatcatattttataaatatacaaccatttttaaaaacctgacaaaatctacaaaaaaaagaaaatgaaatatatgtggagttttagaaaagactgactaggtccaaggttgaggcacatagtggttaagcacattgtcagctccggactctgcctcttacaaggaaggagggggctttagatgttatttagctgttatttagcctttctacacctaagttcccctcacctgtaaaaaaaaaaataataataaattgcttactttgt

SEQ ID NO: 202776 - DNA, 4871 bp, Homo sapiens
  Payload ID: 19996
  Gene Name: zinc finger protein 521
  Uniprot ID: Q96K83
  ENST ID: ENST00000361524
  CDS Start-End: 150-4085
aatgatttcctcagtgattacgtacagagcgagtccctgcgggttaggggccccctctggagccatcctgatggctttgggggccttgcttccattttccattattatgtggactaccggagcgacagcgcagtccaagaccttgcaggatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggaagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtgttgcacatgtattatgtcgtctgatactaaaatggtcttataaagacaagtggacttgggccctattcaggcaagattaaaaaaaaaaaaagactatgaccaaaatggcttaagataaagtatttttaaggaagaaagattaaaaacaactgttatacatgagactatggttggacttccttttctttacacttaagcctagaatttctctttaggtatatcagcgcttaaatccaagactattttttattgctgaagattcttgcaaaccatgaagagatgttctcacagaacagaaccccacagctggataaggcccgtatatatatatttgtaagccttgcaatgtgacaggtagcatcactatatatgcaatagttgttatgtagactgtcaaagaatttttttttccctggatacatttgaagctttgagtgttcaaggttttccttaatgatttcacgcagccaaattcttgaatcagttgaactaacctgtatgttactgttattaatgtttactctgcagtctgaacctggagattactggaattgttttccaagaggaaataaattcagtttaccatta

SEQ ID NO: 202777 - DNA, 4345 bp, Homo sapiens
  Payload ID: 19996
  Gene Name: zinc finger protein 521
  ENST ID: ENST00000399425
  CDS Start-End: 69-3803
ggccttgcttccattttccattattatgtggactaccggagcgacagcgcagtccaagaccttgcaggatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggaagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgaggatattgtcttctctatgactgaagagaccagcgctcatgccaacactactgagatctggaatctcagcatagcttcaccaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtgttgcacatgtattatgtcgtctgatactaaaatggtcttataaagacaagtggacttgggccc

SEQ ID NO: 202778 - DNA, 4253 bp, Homo sapiens
  Payload ID: 19996
  Gene Name: zinc finger protein 521
  Uniprot ID: Q96K83
  ENST ID: ENST00000538137
  CDS Start-End: 199-4134
gacaatgatttcctcagtgattacgtacagagcgagtccctgcgggttaggggccccctctggagccatcctgatggctttgggggccttgcttccattttccattattatgtggactaccggagcgacagcgcagtccaagaccttgcagtttctttcagggctgaattgaaacaacttcagctgtttgcttttaggatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggaagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccat

SEQ ID NO: 202779 - DNA, 694 bp, Homo sapiens
  Payload ID: 19996
  Gene Name: zinc finger protein 521
  ENST ID: ENST00000577801
  CDS Start-End: 21-694
ctgggggccgtcggctcgggatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatga

SEQ ID NO: 202780 - DNA, 338 bp, Homo sapiens
  Payload ID: 19996
  Gene Name: zinc finger protein 521
  ENST ID: ENST00000577461
  CDS Start-End: 248-338
gggaaagtttggtgcagcagccgccgccgccgccgccgccgtcgtgcagagcgcggagctcgggcagccgcgagccccgcgcgcgagcgcgagccggagccggagcgaggagcggagcgcggagcgagggcgcgagggaggccgagcggagggcgcgaggcgccgcggcccgaggggcgcgcggccacgaggaagtatagtttctttcagggctgaattgaaacaacttcagctgtttgcttttaggatgtctcgccgcaagcaagcgaaaccgagatccctcaaagaccccaactgtaaacttgaagacaagactgaagatggagaggcactagatt

SEQ ID NO: 202781 - DNA, 4327 bp, Homo sapiens
  Payload ID: 19996
  Gene Name: zinc finger protein 521
  ENST ID: ENST00000584787
  CDS Start-End: 765-4040
atttcctcagtgattacgtacagagcgagtccctgcgggttaggggccccctctggagccatcctgatggctttgggggccttgcttccattttccattattatgtggactaccggagcgacagcgcagtccaagaccttgcagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggaagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtgttgcacatgtattatgtcgtctgatactaaaatggtcttataaagacaagtggacttgggccctattcaggcaagattaaaaaaaaaaa

SEQ ID NO: 202782 - DNA, 552 bp, Homo sapiens
  Payload ID: 19996
  Gene Name: zinc finger protein 521
  ENST ID: ENST00000577775
  CDS Start-End: 1-552
gcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgactccaaaacaaaggatctggc

SEQ ID NO: 202783 - DNA, 547 bp, Homo sapiens
  Payload ID: 19996
  Gene Name: zinc finger protein 521
  ENST ID: ENST00000580488
  CDS Start-End: 116-547
gttcgcatctgcctcggatggtgggagatttttctttccaagaccttttcatcgccttgcagggtcgatttccccccctcgtccccccaactacaaaagagcacgactcgctttgatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactg

SEQ ID NO: 202784 - DNA, 1102 bp, Homo sapiens
  Payload ID: 19997
  Gene Name: zinc finger protein 524
  Uniprot ID: Q96C55
  ENST ID: ENST00000301073
  CDS Start-End: 79-873
gcgcgcgcacactcgcgagccccggcgacatgcaaatgagctggctccagtgcccagacccaagccccccactgctcaatggacacccccagcccagacccgttgccttcgcctttgcccggggaggaagagaaacctctggccttatctcctcctgttccccggggccgccgaggccgtcgtcctgggggagccacctcctcaaatcggacactcaaggcctccctccctcgcaagcggggccgcccccccaagtcagggcaggagcccccactggtgcaggtgcagggggtgacagccccagtaggcagcagtggcgggagcgacctcctcctgatcgatgatcagggtgtgccctatacggtctctgaaggttcagcggctgggcctgagggctctggccccaggaaggccccacacttctgcccggtgtgcctgcgggccttcccctacctctccgacctggagcgccacagcatctcgcactcagagctgaagccgcaccagtgcaaggtttgcggcaagaccttcaagcgctccagccacctgcggcggcactgcaacatccatgccggcctgcggcccttccgctgcccgctgtgcccccgccgcttccgcgaggcgggcgagctggcgcaccaccaccgcgtgcactcgggggagcgcccgtaccagtgccccatctgccggctgcgctttacagaggccaacacgctccggcgccatgcgaagcgcaagcacccggaggccatgggggtacccctgtgtgcaccagatccagggtctgaaccgccgtgggacgaggagggcatcccggccacagcaggggccgaggaggaggaggagacagaggggaaaggggagccggcctgacccacacccccggccatcgctccctgggccaggtttagagcagggagtttggctggtgctgggcctgagccagggggccgggacacccttgtttccggtggtcttcccgttgtgggagcaggtggagggtggagacctaaactttggggtccagctgccttcagcccccctcccccagactaacagacccttggaggcaggggctgtggaaataaatctctgcctgctg

SEQ ID NO: 202785 - DNA, 1260 bp, Homo sapiens
  Payload ID: 19997
  Gene Name: zinc finger protein 524
  Uniprot ID: Q96C55
  ENST ID: ENST00000591046
  CDS Start-End: 235-1029
agggaagtgcctgtttatcagctgatacaagatcatctcactgttttacccaccagcatagctaaaattgtgtatctggatgaatgtcaaacacacctttgtcaagagacttggagagagggatgggcgaggtgttgggggacacaggggtgctctagaccctgtgagcactgactctgcccctctctcctcttagctggctccagtgcccagacccaagccccccactgctcaatggacacccccagcccagacccgttgccttcgcctttgcccggggaggaagagaaacctctggccttatctcctcctgttccccggggccgccgaggccgtcgtcctgggggagccacctcctcaaatcggacactcaaggcctccctccctcgcaagcggggccgcccccccaagtcagggcaggagcccccactggtgcaggtgcagggggtgacagccccagtaggcagcagtggcgggagcgacctcctcctgatcgatgatcagggtgtgccctatacggtctctgaaggttcagcggctgggcctgagggctctggccccaggaaggccccacacttctgcccggtgtgcctgcgggccttcccctacctctccgacctggagcgccacagcatctcgcactcagagctgaagccgcaccagtgcaaggtttgcggcaagaccttcaagcgctccagccacctgcggcggcactgcaacatccatgccggcctgcggcccttccgctgcccgctgtgcccccgccgcttccgcgaggcgggcgagctggcgcaccaccaccgcgtgcactcgggggagcgcccgtaccagtgccccatctgccggctgcgctttacagaggccaacacgctccggcgccatgcgaagcgcaagcacccggaggccatgggggtacccctgtgtgcaccagatccagggtctgaaccgccgtgggacgaggagggcatcccggccacagcaggggccgaggaggaggaggagacagaggggaaaggggagccggcctgacccacacccccggccatcgctccctgggccaggtttagagcagggagtttggctggtgctgggcctgagccagggggccgggacacccttgtttccggtggtcttcccgttgtgggagcaggtggagggtggagacctaaactttggggtccagctgccttcagcccccctcccccagactaacagacccttggaggcaggggctgtggaaataaatctctgcctgctggc

SEQ ID NO: 202786 - DNA, 489 bp, Homo sapiens
  Payload ID: 19997
  Gene Name: zinc finger protein 524
  ENST ID: ENST00000589521
  CDS Start-End: 99-489
ttcggtatctgtctttgggtcacccgactgtgggctttgtgagaggaaaggcgtttcgagctggctccagtgcccagacccaagccccccactgctcaatggacacccccagcccagacccgttgccttcgcctttgcccggggaggaagagaaacctctggccttatctcctcctgttccccggggccgccgaggccgtcgtcctgggggagccacctcctcaaatcggacactcaaggcctccctccctcgcaagcggggccgcccccccaagtcagggcaggagcccccactggtgcaggtgcagggggtgacagccccagtaggcagcagtggcgggagcgacctcctcctgatcgatgatcagggtgtgccctatacggtctctgaaggttcagcggctgggcctgagggctctggccccaggaaggccccacacttctgcccggtgtgcctgcgggccttcccctacctctccgacctggagc

SEQ ID NO: 202787 - DNA, 3890 bp, Homo sapiens
  Payload ID: 19998
  Gene Name: zinc finger protein 525
  ENST ID: ENST00000474037
  CDS Start-End: 135-1574
ccttccccgctcagacgcgcgcaaacccggaagcagatcgcgtggagtgaaggtccctcagcggcgcgattgacatctaaagactcttggtacatgaggaagaaacccggaaaaggaaagcagaggagtcagggatggctcttcctcagggtctattgacattcagggatgtggccatagaattctctcaggaggagtggaaatgcctggaccctgctcagaggactctatacagggacgtgatgctggagaattataggaacctggtctccctgggtatctcttccaaatgcacaatgaaggagttctcatcaacagcacaaggcaatacagaagtgatccacacagggacattgcaaagacatgaacgtcatcacattggagatttttccttccaggaaattgagaaagatattcataactttgagtttcagtggcaagaagatgaaagaaatggccatgaagcacccatgacaaaaatcaaaaaattgatgggtagtacagagcaatatgatcacaggcatgctggaaacaagcctattaaatatcagcttggatcaagctttcattcacatctgtctgaactccacatatttcagcccaaagggaaaattaataatcaagtggagaagtctatcaacgatgcttcctcggtttcaacagcccaaagaatttcttgtaggcccaaaacccatatatctaataactatggggataattttctgaattattcattactcacacaaagacaggaagtacgcatgagagaaaaatctttccaatgtattgagagtggcaaagcctttaattatagctcactcttaaggaaacatcagattattcatctaggagagaaacaatataaatgtgatgtatgtgacaaggtctttattcggaagcgataccttgcacgccatcgtagatgtcacactggtgagaaaccttacaagtgtaatgagtgtggcaagtccttcagtcagatgtcatcccttacatatcatcatcgacttcatactggagagaaaccttacaaatgtgaagaatgtgacaaagctttcagacacaattcagcccttcaaagacataggagaattcatactggagagaaaccacataagtgtaatgagtgtggcaagacctttagtcagaagtcataccttgcatgccatcgtagcattcatactggaaagaaaccttacgaatgtgaagaatgtgacaaagctttcagtttcaaatcaaaccttgaaagtcataggataactcatactggagagaaaccatacaagtgtaatgattgtggcaagaccttcagtcatatgtcaacccttacatgccatcgtagacttcatactggagagaaaccttacaagtgtgaagaatgtgatgaagctttccgtttcaaatcaagtcttgaaagacataggagaattcataatggagagaaactgtacaaatgtaatgagtgtggcaagaccttcagtcaggagttatcccttacctgccattgtagacttcatagtggagagaaaccttgcaagtgtggagaatgtgacaaggcttacagtttcaaataaaatcttgaaatacgtcagaaaattcatactggagagaaatgttataagtgtaatgattgtggcaagatcttcagtcatacgtcatccattgtataccatcataaatttcatagtggagagaaaccttacaaatgtgaagaatgtgatgaagctttcagtttcaaatcaaaccttgaaagacataggagaattcacactggtgagaaaccttacaggtgtaataggtgtggcaagaccttcagtcatacatcatcccttacatgccatcatagacttcatactggagagaaaccttacaaatgtgaagaatgtgatgaaactttcagatacaaatcaaatcttgaaagacataggagaattcataatggagagaaaccgtacaagtgtaatgagtgtggcaagaccttcagtcagaagtcatgccttacacgccatcatagacttcatactggaaataaatcttataagtgtaatgagtgtggcaagaccttcagtaaggagttaacacatgccatcatagacgtcatactggagagaaaccttagaagtgcaatgagtgtggcaaaacctttcataggcagtcagcgcttatttaccatcaagcaatccatggcagagggaaactttacaaatgtaatgattgtcaccacgtcttcagtaatgctacaactattgcaaatcattggagaatccataataaagagagaccttacaagtgtgataaatgtgacaaatttttcagacatcgttcataccttgcagttcacgggcgaactcatgctggagagaaaccttacaaatgtgaagaatgtgataaagctttcagattcaaatcaaaccttgaaagtcataggagaattcatactagagagaaaccttacaagtgtaatgagtgtggtaagatgttcagtcaaaattcggcccttgtaattcataaggcaattcatactggagagaaaccttacaagtgtaatgaatgtggcaaggtttttaatcgcaaagcaaagcttgcatgtcatcatagacttcatactggagagaacgcttgcaagtgtaataaatgtggcgaggtttttaatcaacaagcacaccttgcacgtcatcatagaactcatactggagagaaacattacaagtgtaatgagtgtggcaagacctactctcacaattcagtccttgtaattcataagacaattcacactggggagaaaccttacaagtgtaatgagtgtggcaaaaccttccatcacaattcagtccttgtaattcataaaacaattcatactggagagaaacaagcgtaatgaatgtggcgaggttttcaatcaacaagcacacgttgcacgtcatcatagaattcatactggagagaaaccttagaaatgtgaagaatgtgacaaagtttacagtcgcaaatcaaacctcgaaagacaggagaattcatactggagagaaaccataaaaatgtaagagtttttgacaaggctttcggacgtgattcacacctggcacaacatcccagagttcacactggagagaaaccttacaagtgtaatgagtgtgtcaaagcctttagtgggcagtcaacacttattcaccatcaggcaatccgtagtgtagggaaacttgactaacgtaatgattctcacaacgtcttcagtaatgctacaaccattgtaaatcactggagaagccataatgaagagagatcttacaaatgtaataattgtggcaaatttttcagacatcgttcatacattgccgttcattggcgaactcatgctggagagaaatcttacaatgtcatgattgtggcaaggtcttcagtcaagcttcatcttttgcaaaacaggagaattcatacaggagagaaacctcacaagtgtgatgatcgtggcaaagcctttacttcacattctcacctcattagacatcagagaatccatactggacagaaatcttacaaatgtcatcagtgtggcaaggtcttcagtccgacttcactccttgcagaatatcagaaaattcatttttcaggtaattgttcccaatgcaatgaatatagcaaaccatcaagcattgattgacattagagtcagttcagcattgacttgagtttgagttgacttaacattgagttcaagccttaattgacattaaagtgtttatgttaagaggactgggctgtgtggcatggctcacgcctgtaatcccagcactttggtaggccaaggtgggtaaatcacttgaggtcaggagtttgagatcagcctggacaacagacctgagccacttttcccagcctgttttttgttt

SEQ ID NO: 202788 - DNA, 1868 bp, Homo sapiens
  Payload ID: 19998
  Gene Name: zinc finger protein 525
  ENST ID: ENST00000475179
  CDS Start-End: 115-267
gcaaacccggaagcagatcgcgtggagtgaaggtccctcagcggcgcgattgacatctaaagactcttggtacatgaggaagaaacccggaaaaggaaagcagaggagtcagggatggctcttcctcagggtctattgacattcagggatgtggccatagaattctctcaggaggagtggaaatgcctggaccctgctcagaggactctatacagggacgtgatgctggagaattataggaacctggtctccctgggatttctatgatgactggattttgaattttgtggaacgctttttctccatctactaaggtgatgtggttttaatctttcattctgttctagtggtatataacattgatttgcttgaatatgttgaaccatccttgcatcccagaaataactggcacttgaatatctacatttttttaatatcctcttgaatacagttttctaggacaagggatcttcaagaagttctggaaaaatacatattatgagaaaattgtgcatgaatttcacaatttttgcaccaaaataaactagtgctagtctgttataacatgtctgaacaggctctagtttgatgccctcaaaaggataagacatgagtataaaaagagactccatcaaagcaatataaattctgatgaaatttaaacaagaagaaacattaaatttatgatgagaccagatgcagtggctcaggcctgtaatcccagcattttcagaggctgagacaggtgggccacatgagcccaggtattcaagaccagcctgggaaacgtggggaaatccccttttctacaaaaaatacaaaaattagctgggcatggtggcacatgcctgccgtctcagttattgtgaagtctgtgcagggaggatggcatgaacctgggaggtcaagattgcagtgagctatgatcatgccactgcactccagcatgggtgatggagagagatactgtcttaaaaaaagaatacttgtggtaacgtttgggtagaggaataatgaaatcattgatgctttataaaaaggttatggggacaatgcccaaaagaaataaacagtttgtaaacggataacttattttgagttagggcaagacaatgttgacagtgatgcatgaagcagcaggcagaccttccacatcatttttacagaaaaaaaaattaatcttgttcatgctgcaatgaagaggactgacagcaaacagcagaaacatagtcagaatttagagaacagcctggttaacatggtgaaacaccatctctagtaaaaatacaaaaattagctcagcatggtggcatgcgcctgtaatcccagctactcaggaggctgaggcaggggaatctcttgaacccaggaggtggaggatgcagtgaactgagatggcaacattacactctagcctgagcaacaagagcaaaactccatctcaaaaaaaaaaaaattgtcaagttccttctcttccattctttgccatcgtggtgtgtgcttgactctgcttcttgccacatcttctcagaagactttcaggattaagcgattcctggccaagaaacaaaagcaaaaccatcccactcccctgtggattcagatcaaaactggtaataaaatcaggtacgactccaaaaggagacattggagaagaaccaagctgggtctataaggaattgcatgtgagatggcacacatatttatgctgtctgagcatcacaatcacgttaccatatcaagctgaaaatgtcaccactatctggacagttggacatgttttattgggaatatgttttttctctgtaaatttgttataaacgcattggttggctgtgttcagtaataaacgtgagacttttcatttc

SEQ ID NO: 202789 - DNA, 6107 bp, Homo sapiens
  Payload ID: 19998
  Gene Name: zinc finger protein 525
  ENST ID: ENST00000467003
  CDS Start-End: 202-1533
acgcgcgcaaacccggaagcagatcgcgtggagtgaaggtccctcagcggcgcaaatgctgaccttggagttgggaatcttctaagtctgaagcttcctgcctgacagggtctattgacattcagggatgtggccatagaattctctcaggaggagtggaaatgcctggaccctgctcagaggactctatacagggacgtgatgctggagaattataggaacctggtctccctgggtatctcttccaaatgcacaatgaaggagttctcatcaacagcacaaggcaatacagaagtgatccacacagggacattgcaaagacatgaacgtcatcacattggagatttttccttccaggaaattgagaaagatattcataactttgagtttcagtggcaagaagatgaaagaaatggccatgaagcacccatgacaaaaatcaaaaaattgatgggtagtacagagcaatatgatcacaggcatgctggaaacaagcctattaaatatcagcttggatcaagctttcattcacatctgtctgaactccacatatttcagcccaaagggaaaattaataatcaagtggagaagtctatcaacgatgcttcctcggtttcaacagcccaaagaatttcttgtaggcccaaaacccatatatctaataactatggggataattttctgaattattcattactcacacaaagacaggaagtacgcatgagagaaaaatctttccaatgtattgagagtggcaaagcctttaattatagctcactcttaaggaaacatcagattattcatctaggagagaaacaatataaatgtgatgtatgtgacaaggtctttattcggaagcgataccttgcacgccatcgtagatgtcacactggtgagaaaccttacaagtgtaatgagtgtggcaagtccttcagtcagatgtcatcccttacatatcatcatcgacttcatactggagagaaaccttacaaatgtgaagaatgtgacaaagctttcagacacaattcagcccttcaaagacataggagaattcatactggagagaaaccacataagtgtaatgagtgtggcaagacctttagtcagaagtcataccttgcatgccatcgtagcattcatactggaaagaaaccttacgaatgtgaagaatgtgacaaagctttcagtttcaaatcaaaccttgaaagtcataggataactcatactggagagaaaccatacaagtgtaatgattgtggcaagaccttcagtcatatgtcaacccttacatgccatcgtagacttcatactggagagaaaccttacaagtgtgaagaatgtgatgaagctttccgtttcaaatcaagtcttgaaagacataggagaattcataatggagagaaactgtacaaatgtaatgagtgtggcaagaccttcagtcaggagttatcccttacctgccattgtagacttcatagtggagagaaaccttgcaagtgtggagaatgtgacaaggcttacagtttcaaataaaatcttgaaatacgtcagaaaattcatactggagagaaatgttataagtgtaatgattgtggcaagatcttcagtcatacgtcatccattgtataccatcataaatttcatagtggagagaaaccttacaaatgtgaagaatgtgatgaagctttcagtttcaaatcaaaccttgaaagacataggagaattcacactggtgagaaaccttacaggtgtaataggtgtggcaagaccttcagtcatacatcatcccttacatgccatcatagacttcatactggagagaaaccttacaaatgtgaagaatgtgatgaaactttcagatacaaatcaaatcttgaaagacataggagaattcataatggagagaaaccgtacaagtgtaatgagtgtggcaagaccttcagtcagaagtcatgccttacacgccatcatagacttcatactggaaataaatcttataagtgtaatgagtgtggcaagaccttcagtaaggagttaacacatgccatcatagacgtcatactggagagaaaccttagaagtgcaatgagtgtggcaaaacctttcataggcagtcagcgcttatttaccatcaagcaatccatggcagagggaaactttacaaatgtaatgattgtcaccacgtcttcagtaatgctacaactattgcaaatcattggagaatccataataaagagagaccttacaagtgtgataaatgtgacaaatttttcagacatcgttcataccttgcagttcacgggcgaactcatgctggagagaaaccttacaaatgtgaagaatgtgataaagctttcagattcaaatcaaaccttgaaagtcataggagaattcatactagagagaaaccttacaagtgtaatgagtgtggtaagatgttcagtcaaaattcggcccttgtaattcataaggcaattcatactggagagaaaccttacaagtgtaatgaatgtggcaaggtttttaatcgcaaagcaaagcttgcatgtcatcatagacttcatactggagagaacgcttgcaagtgtaataaatgtggcgaggtttttaatcaacaagcacaccttgcacgtcatcatagaactcatactggagagaaacattacaagtgtaatgagtgtggcaagacctactctcacaattcagtccttgtaattcataagacaattcacactggggagaaaccttacaagtgtaatgagtgtggcaaaaccttccatcacaattcagtccttgtaattcataaaacaattcatactggagagaaacaagcgtaatgaatgtggcgaggttttcaatcaacaagcacacgttgcacgtcatcatagaattcatactggagagaaaccttagaaatgtgaagaatgtgacaaagtttacagtcgcaaatcaaacctcgaaagacaggagaattcatactggagagaaaccataaaaatgtaagagtttttgacaaggctttcggacgtgattcacacctggcacaacatcccagagttcacactggagagaaaccttacaagtgtaatgagtgtgtcaaagcctttagtgggcagtcaacacttattcaccatcaggcaatccgtagtgtagggaaacttgactaacgtaatgattctcacaacgtcttcagtaatgctacaaccattgtaaatcactggagaagccataatgaagagagatcttacaaatgtaataattgtggcaaatttttcagacatcgttcatacattgccgttcattggcgaactcatgctggagagaaatcttacaatgtcatgattgtggcaaggtcttcagtcaagcttcatcttttgcaaaacaggagaattcatacaggagagaaacctcacaagtgtgatgatcgtggcaaagcctttacttcacattctcacctcattagacatcagagaatccatactggacagaaatcttacaaatgtcatcagtgtggcaaggtcttcagtccgacttcactccttgcagaatatcagaaaattcatttttcaggtaattgttcccaatgcaatgaatatagcaaaccatcaagcattgattgacattagagtcagttcagcattgacttgagtttgagttgacttaacattgagttcaagccttaattgacattaaagtgtttatgttaagaggactgggctgtgtggcatggctcacgcctgtaatcccagcactttggtaggccaaggtgggtaaatcacttgaggtcaggagtttgagatcagcctggacaacagacctgagccacttttcccagcctgttttttgtttctttaacaaaaactgatagggatttttatgggtatcgtattgaatctagattacattgggttatataatcatttaacatattaatttttccaaaccatcaatatgggttgtgtctctatatatgtttttaatcattttgatcaatttttgttgatttcaaggtacaaacgtctcacctttttacgtttattcctaagtatttcttattttaagttctccagcaaatggaagtgtgttaaaattttcttttaaaattgtttattattaaaatatggaaattcaactaatttttggtgctgatactgtattgtgcaaatccactgaatatgtttgttagttccagtactattttggttgagtctgtgattttctacacagaaggtcatgtcgtctacaaacaaatgtaattttacttctttctttctgatttggatgagtttgatttcttttgctatttaattgctctggctaggacaggcagtattgattgaatagaaggggtgagagcattcttgcatcatgtgagatcgtacaggaaagcattccattttccctgcttggttatttactcatttgtcatttcatggatgttctttctattgttgaggtaaatttccttttctattttgtttaggatttctatgatgactggattttgaattttgtggaacgctttttctccatctactaaggtgatgtggttttaatctttcattctgttctagtggtatataacattgatttgcttgaatatgttgaaccatccttgcatcccagaaataactggcacttgaatatctacatttttttaatatcctcttgaatacagttttctaggacaagggatcttcaagaagttctggaaaaatacatattatgagaaaattgtgcatgaatttcacaatttttgcaccaaaataaactagtgctagtctgttataacatgtctgaacaggctctagtttgatgccctcaaaaggataagacatgagtataaaaagagactccatcaaagcaatataaattctgatgaaatttaaacaagaagaaacattaaatttatgatgagaccagatgcagtggctcaggcctgtaatcccagcattttcagaggctgagacaggtgggccacatgagcccaggtattcaagaccagcctgggaaacgtggggaaatccccttttctacaaaaaatacaaaaattagctgggcatggtggcacatgcctgccgtctcagttattgtgaagtctgtgcagggaggatggcatgaacctgggaggtcaagattgcagtgagctatgatcatgccactgcactccagcatgggtgatggagagagatactgtcttaaaaaaagaatacttgtggtaacgtttgggtagaggaataatgaaatcattgatgctttataaaaaggttatggggacaatgcccaaaagaaataaacagtttgtaaacggataacttattttgagttagggcaagacaatgttgacagtgatgcatgaagcagcaggcagaccttccacatcatttttacagaaaaaaaaattaatcttgttcatgctgcaatgaagaggactgacagcaaacagcagaaacatagtcagaatttagagaacagcctggttaacatggtgaaacaccatctctagtaaaaatacaaaaattagctcagcatggtggcatgcgcctgtaatcccagctactcaggaggctgaggcaggggaatctcttgaacccaggaggtggaggatgcagtgaactgagatggcaacattacactctagcctgagcaacaagagcaaaactccatctcaaaaaaaaaaaaattgtcaagttccttctcttccattctttgccatcgtggtgtgtgcttgactctgcttcttgccacatcttctcagaagactttcaggattaagcgattcctggccaagaaacaaaagcaaaaccatcccactcccctgtggattcagatcaaaactggtaataaaatcaggtacgactccaaaaggagacattggagaagaaccaagctgggtctataaggaattgcatgtgagatggcacacatatttatgctgtctgagcatcacaatcacgttaccatatcaagctgaaaatgtcaccactatctggacagttggacatgttttattgggaatatgttttttctctgtaaatttgttataaacgcattggttggctgtgttcagtaataaacgtgagacttttcatttcaaaacaaaagtc

SEQ ID NO: 202790 - DNA, 569 bp, Homo sapiens
  Payload ID: 19998
  Gene Name: zinc finger protein 525
  ENST ID: ENST00000491101
  CDS Start-End: 124-483
cagacgcgcgcaaacccggaagcagatcgcgtggagtgaaggtccctcagcggcgcgattgacatctaaagactcttggtacatgaggaagaaacccggaaaaggaaagcagaggagtcagggatggctcttcctcagggtctattgacattcagggatgtggccatagaattctctcaggaggagtggaaatgcctggaccctgctcagaggactctatacagggacgtgatgctggagaattataggaacctggtctccctgggttcttgctgtgcggttgaagttggtcttgatctcctgggctcaagacatcctcctcggcctcccaagaagctgggattacaggcgccaacccccgtacctaactattggcttttgtttttaaactttttgcatatgtgtgtccttagggctaatatgagtcttctgtggacaacaagtagttggttcctgttgattgagtcagtctttgccttctgagtgcagagttaaatatttgcatttgaaatattactgatgcagaagaccttaccattgcctttttgttacatattatctgtatttct

SEQ ID NO: 202791 - DNA, 590 bp, Homo sapiens
  Payload ID: 19998
  Gene Name: zinc finger protein 525
  ENST ID: ENST00000593918
  CDS Start-End: 99-257
atcgcgtggagtgaaggtccctcagcggcgcgattgacatctaaagactcttggtacatgaggaagaaacccggaaaaggaaagcagaggagtcagggatggctcttcctcagggtctattgacattcagggatgtggccatagaattctctcaggaggagtggaaatgcctggaccctgctcagaggactctatacagggacgtgatgctggagaattataggaacctggtctccctggatggagttttcctctagttgtttaggatggagtgcaattgcacgatcttggctcaccgcaacctccgactcccgggtacaagcctggttttgaactcctgacctcaagtgatttgcccgccttggcctctcaatgtgctgggattacaggcatgagccaccgcgcctggtctgaagtggtattttttagaaacgaactaaaccttttttcagcttaatgacccagggatgtatttctgaaggacttgggagctctctttgaaaggcaaaatacaagggagacagtacctgtatctcagtaggaaattaagtaattcaaacatcaaataattccaatttaaagctatggcc

SEQ ID NO: 202792 - DNA, 156 bp, Homo sapiens
  Payload ID: 19998
  Gene Name: zinc finger protein 525
  ENST ID: ENST00000635711
  CDS Start-End: 1-156
atgtcttctcacaagactttcaggattaagcgattcctggccaagaaacaaaagcaaaaccatcccactcccctgtggattcagatcaaaactggtaataaaatcaggtacgactccaaaaggagacattggagaagaaccaagctgggtctataa

SEQ ID NO: 202793 - DNA, 4023 bp, Homo sapiens
  Payload ID: 19999
  Gene Name: zinc finger protein 526
  Uniprot ID: Q8TF50
  ENST ID: ENST00000301215
  CDS Start-End: 226-2238
gtcgccacgggtaagggcaccgcccaatgggaggtgtggatagtgaggggtcccacacgcctggagccgagggtctgtgtcaagagcggcaggggctgcaggagataagagaaacgggctgccgtggggtgtgtgtaggcttcagagacatgggatcacggaagactgaagcagaaacagtggattaagacttcctgagcgatagctggcactgccttccccacaatggcagaggtggtggctgaggtggccgagatgccaacacagatgtcaccaggggcagtggagatgtcaacacctatgtcggcagagatgatggagatgtcaacagaagtgactgagatgacacctggggaggcccttgcctcatccctcttcttccagcatcaccagttcatgtgctctgagtgtggcagcctctataacacactggaggaagtcctctcacaccaggagcagcacatgcttgctgtctcagaggaggaggcactgaccacacagaatgttggcctggagccggagctggtgccgggtgctgaggggcccttccagtgtggtgaatgcagccagctcatcctctcccctggggagctcctggcccaccaggatgcccacctccgagagtctgcaaaccagatccaataccagtgctgggactgccaggagctgttcccctcgcccgagctgtgggtggctcatcgaaaggcccagcacctttctgctacggtagctgagccaccagtgccacctcctttgcctcccccaacaccactgcctccaccttctcccccatccgaagtcaagatggagccctatgagtgtcctgagtgctctaccctctgcgccacccctgaggagttcttggagcatcagggcacccactttgactccctagagaaagaggagcgcaatgggttggaggaggaggaagaggacgatgaggaggatgaagaagatgatgaagagatggaggatgaggaggccatggcagaggtcggtgatgatgctgtgggaggtgacgagtccacagctggctgggctcagggctgcggggactgtccccagcaccagccctcagcaggggctcgccggcaacaccggcggacggctcacagcccggcatctgccacccaccccttccactgcagccagtgtcagcgcagtttcagctccgccaaccggctgcaggctcatgggcgggcccatgttggtggcacacatgagtgtacaacctgctccaaggtcttcaagaaagcagcatcgcttgagcagcacttgcggctgcatcgcggggaagcccgctacctctgtgtagactgtggccgcggctttggcacagaactcacgttggtggctcaccggcgggcccacactgccaacccattgcatcgctgtcgttgcggcaagacgttcagcaacatgaccaagttcctctaccaccggcgcactcacgccggcaaaagcggggcacctcccacaggagcaacagctcccccagctccagcggagcccacccctccaccaccaccccctgccccacctgcccagctgccctgcccacagtgctccaagtcctttgcctcagcttcccggctgtcccggcaccggcgtgcagtacacgggccccctgaacggcgtcaccgctgtggggtttgtggcaagggcttcaagaagctgatccacgtgcgcaaccacctgcggacacacacgggtgagaggcccttccagtgccactcatgtggcaagacctttgcttctttggccaacctcagccgccaccagctgacccatacgggtgcacgtccctaccaatgcctggactgtggcaagcgcttcacacagagctccaacctgcagcagcaccggcggttgcacttgcggccagtcgcctttgcccgcgccccccgcctccccatcactggtctctacaacaagagtccctactactgcgggacttgtggccgctggttccgcgccatggcgggcttgcgactgcatcagcgggtccatgcccgagctcggactttgacgctacagcctcccagatcaccatctcctgccccacccccacctccagagcctcaacagactatcatgtgcacagagctgggggagaccatcgccatcattgagacatcccagccactggcgcttgaggacaccctgcagctgtgccaggctgcactgggggccagtgaagcaggcgggctcttgcagttggacacggccttcgtgtgacgcagctgaaaagcaacaacaaaagggtttggttgcaacagccagtgtgggtacctctggggagagaggacctcctctgacaaactggtctggtacccaccatgtgccaggatccaccctggcctctttttacccactgactccccagaacaacccttccaggcttctcttgtcatctttctctgcctgaggggaaactgaagctctgaaatgcgatgtgatctgtaccaggtcacccagctatgctgcaaagtgggttggccaaggccctttgcactgcatcaccctggtgcccagcaacatcaggtaaccttcactgagcaccaagcttatgccaggtctgtgctggccactctcatatacctcttcagatcctctgcttgtacccccagcccttgccttccctggattttgggcacccaggactttgctctgcctggtggagggtacttgatttctctgggcttccttcatctcaattctgacagtgtggaaggaaatctgtaggtacccaggtcctcagctccagactgggtgatgctggagacccaggagcaagtcagcacaggctctgcccacaggaggcatgcacaatctggtaggagaaacgcacaagtacagatagcttgctctctgagtgtgtctcattgattcattcagcctgtgtgtcctaaagcctcccttctcccatactgggtgatgctgggggcagagatgagtcaggcctaaggcttctctgggctgtgatggggatgtgcagggacagtgggatcccaggaaacagacctccatggtgggagatcaggagttaaggacttcctagagaaggtagtccctgaaggaaaagtaggaatctggcagtgaaagaggaaaagaacattccaggcagacagcactgcaagagggtgagctcttggtgtatttggagaccatccagttattcatctgactgcctacctgaggcaagcaccacacttaccactgtatgtgtactatgatcccaacaggcttgtgacatagatttcatattatccctgttgtatagatttttaaaactggtggctgggcgtggtggctcacgcctgtaatcccagcactttgggaggccgaggcgggcagatcacgaggtcaggagatcgagaccatcctggctaacacggtgaaaccccgtctctactaaaaatacaaaaaattagccaggagtggtggcgggcgcctgtggtggccagctactcaggaggctgaggcaggagaatggcgtgaacccgggaggcggagcttgcagtgagccgagatcgcgccactgcactccagcctgggcgacagagtgagactccctctcaaaagaaaataaaaataaaaataaactggccaggtgcggtggctcacgcttgcaatcccagtgctttgggagactgaggcaggaggatcacttaaggccaggagttcgagaccagcctgggcaacagcaagacctcatctctacaaaacttaaaagttagccaggcctggtggcacatgcctgtaatccgagtgctttgggaggctgaggcaggaggatcactcgagctcaagaattcaagacctgggcaagagagagagactttgtctctattaaaaataaaaatgattggccgagcatggtggtgcacaccagtattcccagctactctggaggctgaggcggaggcaggattgcttgatatgagggagattgaggctgcagtgagctgtgttcacaccactgcactccagtctgggcaacagtgcaagaccctgtcactt

SEQ ID NO: 202794 - DNA, 573 bp, Homo sapiens
  Payload ID: 19999
  Gene Name: zinc finger protein 526
  ENST ID: ENST00000597945
  CDS Start-End: 368-573
aagagaaacgggtgagggcgccgcgcggggctggactgggaagagaacgctgggcggacggagggggcggaaggaaaactaaggggtctgcagggatcgaagagccttggggcctgcgctagggcgggagcggcgcgggctggaaggagagcactccttcctgtgtgccctggggctcctttagtgtgcgggagcctacgctggaactcgcccaccacccactgctgcgagctctcaccctgccgaggagctcagtctggctgccgtggggtgtgtgtaggcttcagagacatgggatcacggaagactgaagcagaaacagtggattaagacttcctgagcgatagctggcactgccttccccacaatggcagaggtggtggctgaggtggccgagatgccaacacagatgtcaccaggggcagtggagatgtcaacacctatgtcggcagagatgatggagatgtcaacagaagtgactgagatgacacctggggaggcccttgcctcatccctcttcttccagcatcaccagttcatgtgctctgagtgtggcagcctctataacacact

SEQ ID NO: 202795 - DNA, 5333 bp, Homo sapiens
  Payload ID: 20000
  Gene Name: zinc finger protein 527
  ENST ID: ENST00000356178
  CDS Start-End: 88-372
gggtctcggtcgcggggcccgtttgcagagcccgcggcgccgggaggactttgttcttcttcagaagagaaaactgaagaaggaggaatggctgtggggctttgtaaagccatgtcccaggggttggtgaccttcagagatgtggcgctagacttttcccaagaagagtgggaatggctgaagccatctcagaaggatttatacagagatgtcatgttggagaactacaggaacttggtatggcttggtgatggctgcagctgctgtagcactttgagaaccactgtcacggcagaagcttcatcctcctcctcatccatacaagcgtcattccattctctagctcttcctctaatgtccattcttgcctgatgatcaagatattgggtctgcgtcctagacagctgtggcatgttgatttgtttgtctgtatgtctttctgtctcttgctctcatttttcttcccctgtgaacaggactctccatttctaagcccaacatgatctccttactggagcaagggaaggaaccgtggatggtggagagaaagatgtcacagggtcactgtgcagactgggagtcttggtgtgaaattgaggaattatctccaaaatggttcattgatgaagatgaaatatcccaggagatggtaatggaaaggctagcaagtcatggccttgaatgctccagtttcagagaagcctggaaatataagggtgaatttgagctacatcagggaaatgcggagaggcatttcatgcaagtgacagctgttaaggaaatctctactgggaaaagagacaatgaatttagtaattctgggagaagcatacccctgaaatcagtatttttaacacaacagaaagttcctaccatacagcaagtacataaatttgatatttatgataaactcttcccccaaaattcagtcataattgaatataaaagactccatgctgagaaggaatctttgataggtaatgaatgtgaagaattcaaccagagtacgtaccttagtaaagatataggaattcctcctggggagaaaccttatgaaagtcatgatttttcaaagctcttaagtttccactcattatttactcaacatcagaccactcattttggaaaattaccccatggatacgatgaatgtggtgatgcctttagctgttactcattctttactcaacctcagagaattcacagtggagaaaaaccatatgcatgcaatgactgtggaaaagcctttagccacgacttctttctcagtgaacatcaaagaactcatattggggagaaaccttatgaatgtaaggaatgtaacaaagctttcagacagagtgctcaccttgctcaacatcagaggatccacactggagagaaaccgtttgcgtgcaatgaatgtgggaaggcctttagccgttatgccttccttgttgaacatcagagaattcacacaggtgagaaaccatatgaatgtaaagaatgtaataaagccttcagacagagtgctcaccttaatcaacatcagaggattcacactggagagaaaccctatgaatgtaatcagtgtggaaaagccttcagcagacgcatagcccttactctacatcaaagaattcacacaggagagaaacccttcaaatgtagtgaatgtgggaagacctttggctatcgctcacacctgaatcaacatcagagaattcataccggagaaaagccctatgaatgcatcaaatgtgggaagttttttaggactgactcacaacttaatcgacatcatagaattcacactggagagagaccatttgaatgcagtaaatgtgggaaagccttcagtgatgctttagttctaattcaccataagagaagtcatgcaggagagaaaccctatgaatgtaacaaatgtggaaaggccttcagttgtggctcatatcttaatcaacatcaaagaattcatactggagagaaaccctatgaatgtagtgaatgtgggaaggcttttcatcagatcttgtccctaagactacaccagagaattcacgctggagaaaaaccttataaatgtaacgaatgtgggaataattttagctgtgtctcagcccttagacgacatcagagaattcataatagagaaacgctctgattataacaagtataggaaagaaaacatgtggttaccactcaatccttattaaatattagtgagttctttttggttagtaattctttgaatgtagttcatatttcagttcatgagtatccgttatttgaagtagctcagtagtagacatctgttacttttttttttttcagacagagtctcgctctgttgcccaggctggagtgcagtggtgtaatcttggctcactgcagcctctgcctcctgggttcaagcaatcctcctgcctcagcctcctgagtagctgggattacaggtgcctgccaccatacctggctaatttttgtatttttagtagagacggggtttcaccacattggtcaggctgatctcgaactcctgactttaggtgatccacacgcctcagactcccaaagtgctgggattatgggcgtgagccaccgcgcctggccacatctgttactttttgatctgttctatacctggcttagcccaccctcaatgcatatgattcagatgaaactgttaatcagggacagcagtggactggtcacaggctggccaattatttcccccaacctagtgataagggattggcaaatggccctgtctggatcaatgaagtcctttgcgggtattcctatgggcagtaagagaggttttattctggaactgcaagtttcaaggatttaataagattaaaaactcaccagtagcctttttgccactcatgaggaaagctttcccaaagagaaatctaacagaggaaaatggagatgagagacagaaatatgatgatacagcttgatctcctggatccagtcattcctgacagctacaccatcaccatcctttttcattttttgtgatccaataaatttcctttttttgcttaatttggattatatttttgcctcatggaattagagtgctgattcacacattctatgtttgctatacataaaagaaagccttaattttttacgtggcataattatttatcctgaggagcaaccttctgatataacaagtttatgaaagttgaatacacagccttcataaaactgagataattgttacattttatttgtcgataaaactattttagtgtttcttagtttttttcacattatggctgaatattttaaaattcaccaagtaaaattctttaacaggcttccccttaaggagttaaaatcatttgtcacagtgactcaccatttgcctgtaaagagagaatggaaagctaagagaataatactttcatttgtttaatgaatggctcttcatcttcaaggaattacttgattttcttctttcagtatgggtctaaacatattctgtggcagaatataataacaattaaattgtaaatgaggtcttttgtgggtgggctctaaatttggtttaagacccagtgcggtggctcacgcctgtaatccgagcactttgggaggccgaggtgggcagatcacctgaggtcaggagttcgagaccagcctgaccaacatggagaaaccccgtctctactaaaaatacaaaattagccgggtgtggtggtgcgtgcttgtaatcccagctactcaggagggtgaggcaggagaatcacttgaacctgggaagtggaggttacagtgagcgaagatcgcgccattgtactccagcctgggcaacaagagcgaaactccttctcaaaaaaaaaaaaaaaaaaaaaataaataaataaataaataaataaatttggtttaagaagtgtatggataacttctttgcagctagagatatcaaacaaagatattgctggcagaaagaatgagtcatttttaacaaatggtaaaagtaaagcagttaatgcctaaaatttttagagactaaatcatttccattattgggagtaatgaggaagatgaaggtgtagggcaatacgtttcttttttatctgagtggatatagggaaataaactggtgatatggcagctgggccatcttgaatagtgagaaccagtaagaatattgggtattgcctgaagagcatctgtaaaaacatatcagaacaaatgaaagaggaaagaatgaaggatttatatgtgtgcatagagtgaatatatgtgtgcatagagtgaaatattcaacttatacttatttctaataaaatctgaaaattatttttcataaatattcaaattccctttaaacagcttaaaatacagatttagtgactcagtacttcaaaccttgaatagaaacaaatatgattataaaatatttccaaacttatgttacatctaatctgaaacatattaatattataagcttaattcatgtcatcatttctttattttttattatatttcctggaggtataaggatatttatttttataatttccaagcactgagtaataatttatttcagaaagtttcagaaggttacagtaaactttaccaaacttgaagaagaatgactcagatcagtaagaagagtctgagttactcactaattgatttttattttatttatttattttttttgagacagggtctcactctgttatccaggctggaatgcggtgacacaatcatggctcactgcagcctcaacttcccaggctcaagcgaccctcccacctcagcctcctgagtagctgggactacaggtgtgctctaccacacctggctaagtttcgcgtttttctgtagagatggggtttcgcgagttgcccaggctggtctccaactcttggcctgaagtgatttgcccatctcggcttcccaaagtgctgagattatagggatgagtcactgtgcacagctactaattgatttttgatctatgtatggcacctgatttcatcctcgagagtgacgtaaacctaagctactggttcattctctgtttatatagttaaacttcacttgtaatgttgataaaatcttttgtacccatgtgtttagcttcagtgtattttacaatctgatgtttctcctcacaatgaagtactaaattttgtttcttttcaactgtacaacccattgtcttgtgatatattgacctgatctcttaggattagtgaaaatttatgctttattaatatttgattgttattaggaccatctagagatttctgtttatgtgtgtgtatgtgcatctgaagatgtgtattttatttaaattttttgtattaagtgcc

SEQ ID NO: 202796 - DNA, 2828 bp, Homo sapiens
  Payload ID: 20000
  Gene Name: zinc finger protein 527
  Uniprot ID: Q8NB42
  ENST ID: ENST00000436120
  CDS Start-End: 108-1937
attctgggaggtgacgtcgcgggtctcggtcgcggggcccgtttgcagagcccgcggcgccgggaggactttgttcttcttcagaagagaaaactgaagaaggaggaatggctgtggggctttgtaaagccatgtcccaggggttggtgaccttcagagatgtggcgctagacttttcccaagaagagtgggaatggctgaagccatctcagaaggatttatacagagatgtcatgttggagaactacaggaacttggtatggcttggactctccatttctaagcccaacatgatctccttactggagcaagggaaggaaccgtggatggtggagagaaagatgtcacagggtcactgtgcagactgggagtcttggtgtgaaattgaggaattatctccaaaatggttcattgatgaagatgaaatatcccaggagatggtaatggaaaggctagcaagtcatggccttgaatgctccagtttcagagaagcctggaaatataagggtgaatttgagctacatcagggaaatgcggagaggcatttcatgcaagtgacagctgttaaggaaatctctactgggaaaagagacaatgaatttagtaattctgggagaagcatacccctgaaatcagtatttttaacacaacagaaagttcctaccatacagcaagtacataaatttgatatttatgataaactcttcccccaaaattcagtcataattgaatataaaagactccatgctgagaaggaatctttgataggtaatgaatgtgaagaattcaaccagagtacgtaccttagtaaagatataggaattcctcctggggagaaaccttatgaaagtcatgatttttcaaagctcttaagtttccactcattatttactcaacatcagaccactcattttggaaaattaccccatggatacgatgaatgtggtgatgcctttagctgttactcattctttactcaacctcagagaattcacagtggagaaaaaccatatgcatgcaatgactgtggaaaagcctttagccacgacttctttctcagtgaacatcaaagaactcatattggggagaaaccttatgaatgtaaggaatgtaacaaagctttcagacagagtgctcaccttgctcaacatcagaggatccacactggagagaaaccgtttgcgtgcaatgaatgtgggaaggcctttagccgttatgccttccttgttgaacatcagagaattcacacaggtgagaaaccatatgaatgtaaagaatgtaataaagccttcagacagagtgctcaccttaatcaacatcagaggattcacactggagagaaaccctatgaatgtaatcagtgtggaaaagccttcagcagacgcatagcccttactctacatcaaagaattcacacaggagagaaacccttcaaatgtagtgaatgtgggaagacctttggctatcgctcacacctgaatcaacatcagagaattcataccggagaaaagccctatgaatgcatcaaatgtgggaagttttttaggactgactcacaacttaatcgacatcatagaattcacactggagagagaccatttgaatgcagtaaatgtgggaaagccttcagtgatgctttagttctaattcaccataagagaagtcatgcaggagagaaaccctatgaatgtaacaaatgtggaaaggccttcagttgtggctcatatcttaatcaacatcaaagaattcatactggagagaaaccctatgaatgtagtgaatgtgggaaggcttttcatcagatcttgtccctaagactacaccagagaattcacgctggagaaaaaccttataaatgtaacgaatgtgggaataattttagctgtgtctcagcccttagacgacatcagagaattcataatagagaaacgctctgattataacaagtataggaaagaaaacatgtggttaccactcaatccttattaaatattagtgagttctttttggttagtaattctttgaatgtagttcatatttcagttcatgagtatccgttatttgaagtagctcagtagtagacatctgttacttttttttttttcagacagagtctcgctctgttgcccaggctggagtgcagtggtgtaatcttggctcactgcagcctctgcctcctgggttcaagcaatcctcctgcctcagcctcctgagtagctgggattacaggtgcctgccaccatacctggctaatttttgtatttttagtagagacggggtttcaccacattggtcaggctgatctcgaactcctgactttaggtgatccacacgcctcagactcccaaagtgctgggattatgggcgtgagccaccgcgcctggccacatctgttactttttgatctgttctatacctggcttagcccaccctcaatgcatatgattcagatgaaactgttaatcagggacagcagtggactggtcacaggctggccaattatttcccccaacctagtgataagggattggcaaatggccctgtctggatcaatgaagtcctttgcgggtattcctatgggcagtaagagaggttttattctggaactgcaagtttcaaggatttaataagattaaaaactcaccagtagcctttttgccactcatgaggaaagctttcccaaagagaaatctaacagaggaaaatggagatgagagacagaaatatgatgatacagcttgatctcctggatccagtcattcctgacagctacaccatcaccatcctttttcattttttgtgatccaataaatttcctttttttgctt

SEQ ID NO: 202797 - DNA, 999 bp, Homo sapiens
  Payload ID: 20000
  Gene Name: zinc finger protein 527
  ENST ID: ENST00000587349
  CDS Start-End: 75-515
ggggcccgtttgcagagcccgcggcgccgggaggactttgttcttcttcagaagagaaaactgaagaaggaggaatggctgtggggctttgtaaagccatgtcccaggggttggtgaccttcagagatgtggcgctagacttttcccaagaagagtgggaatggctgaagccatctcagaaggatttatacagagatgtcatgttggagaactacaggaacttggtatggcttggactctccatttctaagcccaacatgatctccttactggagcaagggaaggaaccgtggatggtggagagaaagatgtcacagggtcactgtgcaggttctcactctgttgcccaggctggagtgcagtggcatgatcttggctcactgcagcctatacctacggaactcaagcaatcttctcacctcagcatgcacaccactgcacctgatgtcgtcaggatggtagtgaggaggtcatgctccccttcactgtgttctctgtgtcttgcaggtttttaatgctggtctcactctgttatccaggctggaatgcggtgacacaatcatggctcactgcagcctcaacttcccaggctcaagcgaccctcccacctcagcctcctgagtagctgggactacaggtgtgctctaccacacctggctaagtttcgcgtttttctgtagagatggggtttcgcgagttgcccaggctggtctccaactcttggcctgaagtgatttgcccatctcggcttcccaaagtgctgagattatagggatgagtcactgtgcacagctactaattgatttttgatctatgtatggcacctgatttcatcctcgagagtgacgtaaacctaagctactggttcattctctgtttatatagttaaacttcacttgtaatgttgataaaatcttttgtacccatgtgtttagcttcagtgtattttacaatctgatgtttctcctcacaatgaagtactaaattttgtttcttttc

SEQ ID NO: 202798 - DNA, 815 bp, Homo sapiens
  Payload ID: 20000
  Gene Name: zinc finger protein 527
  ENST ID: ENST00000588512
  CDS Start-End: 92-268
tcgcgggtctcggtcgcggggcccgtttgcagagcccgcggcgccgggaggactttgttcttcttcagaagagaaaactgaagaaggaggaatggctgtggggctttgtaaagccatgtcccaggggttggtgaccttcagagatgtggcgctagacttttcccaagaagagtgggaatggctgaagccatctcagaaggatttatacagagatgtcatgttggagaactacaggaacttggactctccatttctaagcccaacatgatctccttactggagcaagggaaggaaccgtggatggtggagagaaagatgtcacagggtcactgtgcagactgggagtcttggtgtgaaattgaggaattatctccaaaatggttcattgatgaagatgaaatatcccaggagatggtaatggaaaggctagcaagtcatggccttgaatgctccagtttcagagaagcctggaaatataagggtgaatttgagctacatcagggaaatgcggagaggcatttcatgcaagtgacagctgttaaggaaatctctactgggaaaagagacaatgaatttagtaattctgggagaagcatacccctgaaatcagtatttttaacacaacagaaagttcctaccatacagcaagtacataaatttgatatttatgataaactcttcccccaaaattcagtcataattgaatataaaagactccatgctgagaaggaatctttgataggtaatgaatgtgaagaattcaaccagagtacgtaccttagtaaagatataggaattcctcctggggagaaacc

SEQ ID NO: 202799 - DNA, 1142 bp, Homo sapiens
  Payload ID: 20000
  Gene Name: zinc finger protein 527
  ENST ID: ENST00000483919
  CDS Start-End: 110-484
ggattctgggaggtgacgtcgcgggtctcggtcgcggggcccgtttgcagagcccgcggcgccgggaggactttgttcttcttcagaagagaaaactgaagaaggaggaatggctgtggggctttgtaaagccatgtcccaggggttggtgaccttcagagatgtggcgctagacttttcccaagaagagtgggaatggctgaagccatctcagaaggatttatacagagatgtcatgttggagaactacaggaacttggtatggcttggactctccatttctaagcccaacatgatctccttactggagcaagggaaggaaccgtggatggtggagagaaagatgtcacagggtcactgtgcaggttctcactctgttgcccaggctggagtgcagtggcatgatcttggctcactgcagcctatacctacggaactcaagcaatcttctcacctcagcatgcacaccactgcacctggttaatttttttgtttatttttcttgtagagacgaggtctcactgtgttgcccaggctggtctagcactcctgggctcaagcgatcctcccatcttggcatcccaaactgttgggattactggcatacttccacttttggagaattagattatttttctttttcttactgatttgtagtagaactaaattctgggcattattcatttttctatgatatatgttttagttgttttttctcagattgtcccttgccttttgactttgtgttttctcccgcacacaagttttcaaggttaatgtcaaattcattcctttcaaccagatgtcgtcaggatggtagtgaggaggtcatgctccccttcactgtgttctctgtgtcttgcaggtttttaatgctgtaagtgtgtttctcttgatatttttttcatgaccttttccacaatgatagggaattttacaagtcaaccctggttgagttctttcacagagattttggtggaagaaaggtataaaatgcaagggcttaggtcctattattggttttggaatgttctttttttgttcataattttcttttatattattgattacttttgtccaagtttatttaaaataattttcttaagttctgaaataaaatccttatggaattctggttgaaa

SEQ ID NO: 202800 - DNA, 580 bp, Homo sapiens
  Payload ID: 20000
  Gene Name: zinc finger protein 527
  ENST ID: ENST00000588911
  CDS Start-End: 108-580
attctgggaggtgacgtcgcgggtctcggtcgcggggcccgtttgcagagcccgcggcgccgggaggactttgttcttcttcagaagagaaaactgaagaaggaggaatggctgtggggctttgtaaagccatgtcccaggggttggtgaccttcagagatgtggcgctagacttttcccaagaagagtgggaatggctgaagccatctcagaaggatttatacagagatgtcatgttggagaactacaggaacttggtatggcttgactgggagtcttggtgtgaaattgaggaattatctccaaaatggttcattgatgaagatgaaatatcccaggagatggtaatggaaaggctagcaagtcatggccttgaatgctccagtttcagagaagcctggaaatataagggtgaatttgagctacatcagggaaatgcggagaggcatttcatgcaagtgacagctgttaaggaaatctctactgggaaaagagacaatgaatttagtaattctgggagaagcatacccctgaaatcagtatttttaacacaacagaaagttcctaccatacagcaagt

SEQ ID NO: 202801 - DNA, 3978 bp, Homo sapiens
  Payload ID: 20001
  Gene Name: zinc finger protein 528
  Uniprot ID: Q3MIS6
  ENST ID: ENST00000360465
  CDS Start-End: 427-2313
agccgattgcagggagaaactgttttcgcagcagtgcgcctcccttttccagccaccggttctcctgaccccgagtgtggggggtgacttcagtctcctgacatccagtgttctctcgagccagtttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggttcacaaattttaagaaagggagaataaagtgaaaaaaatctcagaaggaatccactcaacagacgaggattcacttccaaagagacatattatgcaaggaagcaacttggaagaggaaagaaaagaagtcaggaatggcccttactcagggacccttgaaattcatggatgtggccatagagttctctcaggaagagtggaaatgcctggaccctgcgcagaggactttatacagggacgtgatgttggagaattataggaacctggtctccctgggaatctgtcttcctgacctgagtgttacctccatgttagagcaaaagagagatccctggactctgcagagtgaagagaaaatagcaaacgatccagacggcagggagtgcatcaaaggtgtgaacacagagaggagctctaaattgggaagtaatgcaggaaacaagccttgtaaaaatcaacttggattcacttttcagttacatctgagtgatctacagctatttcaagctgaaaggaaaatttctgggtgtaagcattttgaaaaacccgtcagtgacaattcctcagtttcaccgcttgaaaaaatttcttccagtgtcaaatcccaccttttaaataaatatagaaataattttgatcatgctccattacttccacaagaacagaaagcacacattagggaaaaagcttataaatgtaatgagcacggccaagtctttagagcatctgcaagccttactaaccaagtaatccataacgcagataatccttacaaatgcagtgaatgtggcaaggtctttagttgcagttcaaagcttgtgatacatcgaagaatgcatactggagagaagccttacaaatgtcatgaatgtggcaagctcttcagtagcaattcaaacctttcacaacatcaaagaattcatactggagagaagccttacaaatgtcatgaatgtgacaaggtctttcgaagcagttcaaagcttgcacaacatcaaagaattcatactggagagaagccttacaaatgtcatgaatgtgacaaggtcttcaatcaaattgcacaccttgtacgacatcaaaaaattcatactggagagaaaccttacagttgtaataaatgtggcaaggtctttagtcgccattcatatctagcagaacatcaaacggttcatactggtgagaaaccttacaaatgtgaagaatgtggcaaagcattttcagtgcgttccagcctcataacccatcagttaattcacactggaaggaaaccttacaaatgtaaagaatgtgacaaggtctttgggcgcaagtgtttcctgacctctcatcagagaattcatactagagagagaccttatggatgcagtcagtgtggcaagatctttagtcagaaatcagaccttatacgacatcgaaaaactcatactgatgagaagccttacaaatgtaataaatgtggcacagcgtttagagagttttcagaccttactgcccattttctaatccatagtggagagaaaccttatgaatgtaaagaatgtggcaaagtcttcaggtacaagtcttctctaaccagtcatcatagaattcatactggagagaagccttacaaatgtaacagatgtggcaaggtcttcagtcgcagttcaaacctggtatgccatcagaaaattcatacaggagaaaagccttacaaatgtaatcaatgtggcaaggtctttaatcaagcatcataccttacaagacatcaaataattcatactggagagaggccttacagatgtagtaaatgtggcaaagcatttcgagggtgttcaggccttactgcccatcttgcaatccatactgaaaagaaatctcatgagtgtaaagaatgtggcaagatcttcactcagaagtcttccctcaccaatcaccatagaattcacattggagagaaaccttacaaatgcaccctgtgcagtaaggtcttcagtcacaattctgaccttgcacagcatcagagagttcattcatgagagtccctacaaactgtatggcaaaaccatcatcatgagttctagcattaatcaacatcagtgagtccatactaagtggaaatcatataaatgaaatgtatgtgacacaggctttatcaaggcctgccaaatcactggacatcaccacatcactgtggaggatgaaagcacacagatgaattgtgtgtacttgggctattattcaaggaccattgctatagaacacgataggatttacacaagaagtaactctgtctctggttctctgatactaatctatgatattgcatgatgcagaataatgctaagtcaaaatatgttgaatctcatgacctgatgtatatcaaaggtgcaacggcttgtaaatgaccagttttattcaggctataaagcattcaattatttggggcttatagaaaaggctactttactctttgtgacttcgaaatcttttcatgtgccttccatacaggccattcactgtggtccctgggaaagaatcagtaggatgacagggctgacttcattagctgaggattatttctatccaatttcctgatgaaggacattgccttttgagattaaatattgtctgatttagagagcatggaggtgggcagagtaacataaaactgatgaccgtcatcatactgttgcagttagcacactttctcctgacataagtgcacagagcttcagtgtccaccaactgaccatgaaatagagtatgctgtaatcttaaggcataggttattagtgggaagagagtaataggttgctagtgtctgattatatggtagaaataatgcaaggaaaaaggtagccaccttctccattgaacagcagtacctgctgtttagcaaagactgatgagaagtagacttttttttttttggagatagagtctcactctgttgcccaggctggagtgtagtggtgtgttcttggctcactgcaccctccgcctcctgggctcaagcagtccttctgccttagcctcctaagtagctgagactacagacgtgcgccaccacacccagttcatttttgtatttttagtagagacagtgtttaccatgttggccaggcaggtctccaactcctgacctcaagtgatatgttcacctcagcctcccaaagtgctgggattacaggcatgaaccatggtgcccagcctcatttttgaaatggaatagagaacagttatatcacagttgagagtttaatcaaaatgaccggatcagcatattctttttttagatgagacagagtttcgcccttgtcacccaggctgtagtgcggtggcgcgatctcggctcactgcaacctccgcctcccgggttcaagcaattctcctgcctcagcctcccaagtagctgggattacaggcgtgtaccaccatacccagctaatttttgtatttttagtagagatggggtttcaccacgttggccacactggtctcaaactcctgacctcaggcgatccatctgcctcagcctgaaagtgctaggattacaggcgtgagccaccacacctggccagctcagcatattcttaagtaggattcacatttaattcttggtattataagttgcaaccatttgatttagaatgtatgcagctctcatgtttgtagtaataaagtttcatttttcctaagta

SEQ ID NO: 202802 - DNA, 582 bp, Homo sapiens
  Payload ID: 20001
  Gene Name: zinc finger protein 528
  ENST ID: ENST00000391787
  CDS Start-End: 340-582
agccgattgcagggagaaactgttttcgcagcagtgctttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggttcacaaattttaagaaagggagaataaagtgaaaaaaatctcagaaggaatccactcaacagacgaggattcacttccaaagagacatattatgcaaggaagcaacttggaagaggaaagaaaagaagtcaggaatggcccttactcagggacccttgaaattcatggatgtggccatagagttctctcaggaagagtggaaatgcctggaccctgcgcagaggactttatacagggacgtgatgttggagaattataggaacctggtctccctgggaatctgtcttcctgacctgagtgttacctccatgttagagcaaaagagagatccctggactctgcagagtgaagagaaaatagcaaacgatccagacggc

SEQ ID NO: 202803 - DNA, 4209 bp, Homo sapiens
  Payload ID: 20001
  Gene Name: zinc finger protein 528
  ENST ID: ENST00000391788
  CDS Start-End: 524-895
agtttccggtagacccggaagccgattgcagggagaaactgttttcgcagcagtgcgcctcccttttccagccaccggttctcctgaccccgagtgtggggggtgacttcagtctcctgacatccagtgttctctcgagccagtttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggattcacttccaaagagacatattatgcaaggaagcaacttggaagaggaaagaaaagaagtcaggaatggcccttactcagagtctcacacgttgcccaggctggagtgcagtggcatgatccctgctcattgcaacctccgcctccctgattcaaaggatttttccacctcagcttctcatgtagctgagattacagggacccttgaaattcatggatgtggccatagagttctctcaggaagagtggaaatgcctggaccctgcgcagaggactttatacagggacgtgatgttggagaattataggaacctggtctccctgggaatctgtcttcctgacctgagtgttacctccatgttagagcaaaagagagatccctggactctgcagagtgaagagaaaatagcaaacgatccagacggcagggagtgcatcaaaggtgtgaacacagttcctctactccagcagaaccttctttgttcacgtcctcaaagtcctatgttcggaggccacttgtccgacatcctcggagtccctcttctgggtcaccagttgccacctgcacagaccttgggggactgaacgaagggggcgaacattggaataaaagacaaagagaggagctctaaattgggaagtaatgcaggaaacaagccttgtaaaaatcaacttggattcacttttcagttacatctgagtgatctacagctatttcaagctgaaaggaaaatttctgggtgtaagcattttgaaaaacccgtcagtgacaattcctcagtttcaccgcttgaaaaaatttcttccagtgtcaaatcccaccttttaaataaatatagaaataattttgatcatgctccattacttccacaagaacagaaagcacacattagggaaaaagcttataaatgtaatgagcacggccaagtctttagagcatctgcaagccttactaaccaagtaatccataacgcagataatccttacaaatgcagtgaatgtggcaaggtctttagttgcagttcaaagcttgtgatacatcgaagaatgcatactggagagaagccttacaaatgtcatgaatgtggcaagctcttcagtagcaattcaaacctttcacaacatcaaagaattcatactggagagaagccttacaaatgtcatgaatgtgacaaggtctttcgaagcagttcaaagcttgcacaacatcaaagaattcatactggagagaagccttacaaatgtcatgaatgtgacaaggtcttcaatcaaattgcacaccttgtacgacatcaaaaaattcatactggagagaaaccttacagttgtaataaatgtggcaaggtctttagtcgccattcatatctagcagaacatcaaacggttcatactggtgagaaaccttacaaatgtgaagaatgtggcaaagcattttcagtgcgttccagcctcataacccatcagttaattcacactggaaggaaaccttacaaatgtaaagaatgtgacaaggtctttgggcgcaagtgtttcctgacctctcatcagagaattcatactagagagagaccttatggatgcagtcagtgtggcaagatctttagtcagaaatcagaccttatacgacatcgaaaaactcatactgatgagaagccttacaaatgtaataaatgtggcacagcgtttagagagttttcagaccttactgcccattttctaatccatagtggagagaaaccttatgaatgtaaagaatgtggcaaagtcttcaggtacaagtcttctctaaccagtcatcatagaattcatactggagagaagccttacaaatgtaacagatgtggcaaggtcttcagtcgcagttcaaacctggtatgccatcagaaaattcatacaggagaaaagccttacaaatgtaatcaatgtggcaaggtctttaatcaagcatcataccttacaagacatcaaataattcatactggagagaggccttacagatgtagtaaatgtggcaaagcatttcgagggtgttcaggccttactgcccatcttgcaatccatactgaaaagaaatctcatgagtgtaaagaatgtggcaagatcttcactcagaagtcttccctcaccaatcaccatagaattcacattggagagaaaccttacaaatgcaccctgtgcagtaaggtcttcagtcacaattctgaccttgcacagcatcagagagttcattcatgagagtccctacaaactgtatggcaaaaccatcatcatgagttctagcattaatcaacatcagtgagtccatactaagtggaaatcatataaatgaaatgtatgtgacacaggctttatcaaggcctgccaaatcactggacatcaccacatcactgtggaggatgaaagcacacagatgaattgtgtgtacttgggctattattcaaggaccattgctatagaacacgataggatttacacaagaagtaactctgtctctggttctctgatactaatctatgatattgcatgatgcagaataatgctaagtcaaaatatgttgaatctcatgacctgatgtatatcaaaggtgcaacggcttgtaaatgaccagttttattcaggctataaagcattcaattatttggggcttatagaaaaggctactttactctttgtgacttcgaaatcttttcatgtgccttccatacaggccattcactgtggtccctgggaaagaatcagtaggatgacagggctgacttcattagctgaggattatttctatccaatttcctgatgaaggacattgccttttgagattaaatattgtctgatttagagagcatggaggtgggcagagtaacataaaactgatgaccgtcatcatactgttgcagttagcacactttctcctgacataagtgcacagagcttcagtgtccaccaactgaccatgaaatagagtatgctgtaatcttaaggcataggttattagtgggaagagagtaataggttgctagtgtctgattatatggtagaaataatgcaaggaaaaaggtagccaccttctccattgaacagcagtacctgctgtttagcaaagactgatgagaagtagacttttttttttttggagatagagtctcactctgttgcccaggctggagtgtagtggtgtgttcttggctcactgcaccctccgcctcctgggctcaagcagtccttctgccttagcctcctaagtagctgagactacagacgtgcgccaccacacccagttcatttttgtatttttagtagagacagtgtttaccatgttggccaggcaggtctccaactcctgacctcaagtgatatgttcacctcagcctcccaaagtgctgggattacaggcatgaaccatggtgcccagcctcatttttgaaatggaatagagaacagttatatcacagttgagagtttaatcaaaatgaccggatcagcatattctttttttagatgagacagagtttcgcccttgtcacccaggctgtagtgcggtggcgcgatctcggctcactgcaacctccgcctcccgggttcaagcaattctcctgcctcagcctcccaagtagctgggattacaggcgtgtaccaccatacccagctaatttttgtatttttagtagagatggggtttcaccacgttggccacactggtctcaaactcctgacctcaggcgatccatctgcctcagcctgaaagtgctaggattacaggcgtgagccaccacacctggccagctcagcatattcttaagtaggattcacatttaattcttggtattataagttgcaaccatttgatttagaatgtatgcagctctcatgtttgtagtaataaagtttcatttttcctaagt

SEQ ID NO: 202804 - DNA, 501 bp, Homo sapiens
  Payload ID: 20001
  Gene Name: zinc finger protein 528
  ENST ID: ENST00000448954
  CDS Start-End: 1-256
tttatacagggacgtgatgttggagaattataggaacctggtctccctgggaatctgtcttcctgacctgagtgttacctccatgttagagcaaaagagagatccctggactctgcagagtgaagagaaaatagcaaacgatccagacggcagggagtgcatcaaaggtgtgaacacagattccccactgctccaatgcatcacctcagttccttgtgttttctgcactgccagcatgatacacacaataccctgatactcctaccaatgtctgagtcagagaggagctctaaattgggaagtaatgcaggaaacaagccttgtaaaaatcaacttggattcacttttcagttacatctgagtgatctacagctatttcaagctgaaaggaaaatttctgggtgtaagcattttgaaaaacccgtcagtgacaattcctcagtttcaccgcttgaaaaaatttcttccagtgtcaaatcccaccttttaaataaatataga

SEQ ID NO: 202805 - DNA, 465 bp, Homo sapiens
  Payload ID: 20001
  Gene Name: zinc finger protein 528
  ENST ID: ENST00000436397
  CDS Start-End: 423-465
agccgattgcagggagaaactgttttcgcagcagcctcccttttccagccaccggttctcctgaccccgagtgtggggggtgacttcagtctcctgacatccagtgttctctcgagccagtttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggttcacaaattttaagaaagggagaataaagtgaaaaaaatctcagaaggaatccactcaacagacgaggattcacttccaaagagacatattatgcaaggaagcaacttggaagaggaaagaaaagaagtcaggaatggcccttactcagggacccttgaaattcatggatgtggcca

SEQ ID NO: 202806 - DNA, 590 bp, Homo sapiens
  Payload ID: 20001
  Gene Name: zinc finger protein 528
  ENST ID: ENST00000493272
  CDS Start-End: 566-590
gattgcagggagaaactgttttcgcagcagcctcccttttccagccaccggttctcctgaccccgagtgtggggggtgacttcagtctcctgacatccagtgttctctcgagccagtttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggttcacaaattttaagaaagggagaataaagtgaaaaaaatctcagaaggaatccactcaacagacgaggattcacttccaaagagacatattatgcaaggaagcaacttggaagaggaaagaaaagaagtcaggaatggcccttactcagagtctcacacgttgcccaggctggagtgcagtggcatgatccctgctcattgcaacctccgcctccctgattcaaaggatttttccacctcagcttctcatgtagctgagattacagggacccttgaaattcatggatgtggccatagagttctctc

SEQ ID NO: 202807 - DNA, 579 bp, Homo sapiens
  Payload ID: 20001
  Gene Name: zinc finger protein 528
  ENST ID: ENST00000494167
  CDS Start-End: 570-579
gattgcagggagaaactgttttcgcagcagtgcgcctcccttttccagccaccggttctcctgaccccgagtgtggggggtgacttcagtctcctgacatccagtgttctctcgagccagtttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggttcacaaattttaagaaagggagaataaagtgaaaaaaatctcagaaggaatccactcaacagacgaggattcacttccaaagagacatattatgcaaggaagcaacttggaagaggaaagaaaagaagtcaggaatggcccttactcagagtctcacacgttgcccaggctggagtgcagtggcatgatccctgctcattgcaacctccgcctccctgattcaaaggatttttccacctcagcttctcatgtagctgagattacagggacccttgaaattcatggatgtgg

SEQ ID NO: 202808 - DNA, 544 bp, Homo sapiens
  Payload ID: 20001
  Gene Name: zinc finger protein 528
  ENST ID: ENST00000594530
  CDS Start-End: 21-341
ggaaagaaaagaagtcaggaatggcccttactcagggacccttgaaattcatggatgtggccatagagttctctcaggaagagtggaaatgcctggaccctgcgcagaggactttatacagggacgtgatgttggagaattataggaacctggtctccctgggaatctgtcttcctgacctgagtgttacctccatgttagagcaaaagagagatccctggactctgcagagtgaagagaaaatagcaaacgatccagacggcagggagtgcatcaaaggtgtgaacacaggtgagagctcgggtgggcagagtggaggccccataatttttgttttttgagacagggtctaacgctgtcatccaggctagagtgcggtggcaatcatagctcactgcagccttgaattcctggacttaagggatctccctggctcgctcttccaaagtgttgggattacagccatgagccactgtaccctgcaaagccacactattacatagcgtttgggaaactctctgcaaatgggagaattctgtgggaa

SEQ ID NO: 202809 - DNA, 625 bp, Homo sapiens
  Payload ID: 20001
  Gene Name: zinc finger protein 528
  ENST ID: ENST00000598192
  CDS Start-End: 68-343
gattcacttccaaagagacatattatgcaaggaagcaacttggaagaggaaagaaaagaagtcaggaatggcccttactcagggacccttgaaattcatggatgtggccatagagttctctcaggaagagtggaaatgcctggaccctgcgcagaggactttatacagggacgtgatgttggagaattataggaacctggtctccctgggaatctgtcttcctgacctgagtgttacctccatgttagagcaaaagagagatccctggactctgcagagtgaagagaaaatagcaaacgatccagacggcagggagtgcatcaaaggtgtgaacacaggctgatctcggctcactacagcctctgcctctctggtccaagtgattctcctgcctcagcctcctgagtagctgggattacaggcgcccatccccacccctggctaatttttgtatttttagtagaaacaggtttttgccatatttgccaggctgctctccaactcctgacctcaagtgatccacctgcctcggcctcccaaagtgctgggattacaggtgtgccactgtacctggcctgattgtgtcttttaaattgtaggaaagaattaaaagtcaagttacaaa

SEQ ID NO: 202810 - DNA, 5238 bp, Homo sapiens
  Payload ID: 20002
  Gene Name: zinc finger protein 529
  ENST ID: ENST00000334116
  CDS Start-End: 612-1988
ttattgagttaagcctggcgagtcgaggtgacccgggccgggctgcgggaggagctcgcggtgaggtggccccgcgctgccgggcgaggtcggtccacgtggagccgggagcctgaggcctctgtacgcgggagctgcggacgatggtgttctgcaagtgaaggccccctgaagtggaagacagcattggtactaatggccaactcaagtttcattggggatcatgtccatggagctcctcatgctgtcatgccagaagtggaattccctgaccaattctttacagttctaaccatggaccatgaactggtgacactcagggatgtggtcatcaacttctctcaggaggaatgggaatatctggattctgctcagaggaacttgtactgggatgtgatgatggagaactacagcaacttactctcactgggtctacattgagacagatatcggtacaatggtgaccaagaccaatacagaccctgctctcatggaattgacatactagttcttgagatgtataataaacaaatttggagtccaggaatgagactaagcatttatctgtaggaaaagatattattcaaaacactggttctcagtgggaggtaatggaaagtagcaagttatgtggccttgaaggttccattttcagaaatgactggcaaagcaaaagcaagattgacttacaaggacctgaagtgggatatttcagtcaaatgaaaatcatctctgaaaatgtgcccagttacaaaactcatgaatctcttactttacctcggagaactcatgacagtgagaagccctatgaatacaaggaatatgagaaggtcttcagttgtgacttagagtttgatgaatatcagaaaatacatactggtggaaaaaactatgaatgtaatcaatgttggaaaacctttgggatagataactccagtatgttacaactgaatattcatactggtgtgaaaccttgtaaatatatggaatatgggaatacatgtagtttttataaagactttaatgtataccagaaaattcataatgagaagttctataaatgtaaggaatacagaaggacctttgaaagagttggaaaagttactccacttcaaagagttcatgatggtgagaaacactttgaatgctcattctgtgggaaatcctttagagtgcatgcacaacttactcgacatcagaaaatccatactgatgagaaaacttacaaatgtatggaatgtggcaaggacttcagatttcattcacagcttaccgaacatcagagaattcatactggtgagaaaccctacaaatgtatgcactgtgagaaggtttttagaattagttcacagctcattgaacatcagagaattcacactggtgagaaaccttatgcatgtaaggaatgtgggaaggcttttggagtatgtagagaacttgctcgtcatcagagaattcatactggtaagaaaccctatgaatgcaaagcatgtggaaaggtctttagaaatagttcatccctgactagacatcagaggattcatactggtgaaaaaccctataaatgtaaagaatgtgagaaagcatttggagtaggtagtgaacttactcgacatgaaagaattcacagtggtcaaaaaccttatgaatgtaaggagtgtggaaagttctttagacttacgtcagcccttattcaacatcaaagaattcatagtggtgagaaaccttatgaatgtaaggtatgtgggaaggcctttagacatagttcagcccttacagaacatcagagaattcatactggagaaaaaccctatgaatgcaaggcatgtgggaaggcctttagacatagttcatcctttaccaaacatcagcgcattcatactgatgataaaccctatgaatgtaaggagtgtgggaattcctttagtgttgttgggcatcttacttgccaaccgaaaatttacactggtgagaaatcatttgactgaaataaatgtataaagtggttttttatttctgattttcacaggaaaatactgtggatggatttaataggtaatcaaggcaattcagtatctccctctcttaaagtctgtttttagacttcatggtcattctgtatgtagacgtagaattgcttagtcatagctgatatatacttatagctttgttagatgttgccaaatatttctcctttttatgttaaaaagtttttttcatgagtttctcatcctggcatgttttgtttacaatagcttttgatgtttgtattattgctcttttgactattcagttttttaattgtaatattacttcaatatcttttctgcattgtaattctttgcttgtgatatctatacttacttattttcctccacagagttagcactcctagtcagatacaatgtatttttacagtcttacagctcatcattttgtgtaatgttgttttgttttgttttaaatgatagaagtgtgatctcctttccattttcatccaattgttgacttctctttaaatttctactttattttgatacaacatattccccccaaaaaaacacatacataggaactggttatattccaccataacacacacacacacacacacacactatatacatatagtgtatatacacatatagtgtatatagtgtatgtgtgatgtatactatacatatcacatatactatatgtgtgtatatagtgtgtgatgtatatgtgtgtgatgtatactatatatgcccacacatgcactacataacacactatatatatatatatatatacacacacacacacacaatatatgtatatatagtatatacactatatactgggcactatatatatatagtgtgtatgtgtgttatattggaatataaccagttcctttaagcagtctttttacctgcaggctataccaaccaggatccaaatgaagagaactcttttaaatatttgataaaactactcacccagtaagtctcttaaaatttatcattctcttaaagtatcactctaaaatttgtcaaacacctttaaaaggggagaaaaaatgaccactgaacttacattaagagaatttacaactatatattaacatggcttcaattgtttttttaatctattatcattatttttctttttattccctctcagagttgacttactaggtttgggcatttcaacaatcagcagaccttctttggtttaactaatctcatttaactccaaaatcatctctctcttaggactgctgacttggttatgcagtcaatgagatcacgagccactggttattggattttttttctttttttttagacagagttttgctcttgttgcctaggctggagtgcagtggcgcagtcttggctcacctcaacctctgcctcccaggttcaggctattctcctgctcagcctcctgattagctgggattacaggcatgcgccaccatgaccggctaattttatatttttagtagagacgggatatctccgtgttggtcagtctggtctcaaactcccgacctcaggtgatccacccgcctcagcctcccaaagtgctgggattacaggcatgagccaccgcacccagcctggttattggatttatttatttattttgagatagagccttgctctgtcaccaggccggagtgcagtggtgtcatctcagatcactgcaacctccacctcccaggttcaagcgattcccctgcctcagcctgccaagtagctgggattacaggcatgcgccaccatgcccagctaattgtattttagtagatatggagtttcaccacgttggccaagacagtctcgatttcctgaccttgtgatccccctgcctcggcctcccaaagtgctgggattacaggcatgagccaccacgcctgtccggttatttgatttttataagaaaattttactattattttcagataaatttatgtcactgtcattcattacattttaatttttgaaactgatgtctttcccagaatttatgtactctataacggtgtgaatgattaccagtattaagccattttctcatctgatatattgagctatgttttatgtaagtattgcttattcaagtagttttaaaagatatgtaattggttgttgtttcatgtcctacacagtaagaacaagagtatgttaacctttttgtcaggatatttgctatttcatatctttgaaatagagtagtagctctatttctaactaaattctatttatgtaacaacacagctaatttactcttggatctcattctccctttttatcctgagttaccatcagtgctaatgttcctcttttgggtatagttctccaggagaacttgtcctatatttctttgtgtgtgtttttttccttccagcttaaacaaattaaaactaaatatctaaaccttgtatacagacattaaaattagtgagagaaacaaaatatccttgtgtcttggcttttactttttgaagtcattaacaaataataaattaatgaataaaatgtgtccttattatgttttccttgtttgtagttacagctatatttttatcatattaacatttttcacttaacttcgtaatgaacttatggcatttcacacttactcgaaaccataatataattattattggtggtattactgtttggtttttactatttttactcaaaaacataaaacttcaccattctttccattttcatttgcccctttattctttctgacttttctctaagcctgcataggagctttattctcatattcaataggataggatattgcagtctcatcctgttttctgctgtcctgcaccattaaattttatatgtccttgaaggaattcaatttaatggcaactaatatatgtatgttagggacaggtaaagagtctgtgactgagatttctggagttatataacccctgcgccaccccccaccccaactccaacttgccagaattcaccccttaacctgcaatgtgattgtatttggacatagggcaatgaggacataagaatgtgattctaatttgatacaaatggtgatcttatgagaagaggaaggagagacgtctcttcctatgctcacacacaaaggaaagtccacatgaggacacaaggagaagccaagagagcccttaccaggaattaaacctgctaatccctattttaattagaacagtgagaaaataaatatctgtatttaagcctc

SEQ ID NO: 202811 - DNA, 4331 bp, Homo sapiens
  Payload ID: 20002
  Gene Name: zinc finger protein 529
  Uniprot ID: Q6P280
  ENST ID: ENST00000591340
  CDS Start-End: 160-1851
gccgggctgcgggaggagctcgcggtgaggtggccccgcgctgccgggcgaggtcggtccacgtggagccgggagcctgaggcctctgtacgcgggagctgcggacgatggtgttctgcaagtgaaggccccctgaagtggaagacagcattggtactaatggccaactcaagtttcattggggatcatgtccatggagctcctcatgctgtcatgccagaagtggaattccctgaccaattctttacagttctaaccatggaccatgaactggtgacactcagggatgtggtcatcaacttctctcaggaggaatgggaatatctggattctgctcagaggaacttgtactgggatgtgatgatggagaactacagcaacttactctcactggatttggagtccaggaatgagactaagcatttatctgtaggaaaagatattattcaaaacactggttctcagtgggaggtaatggaaagtagcaagttatgtggccttgaaggttccattttcagaaatgactggcaaagcaaaagcaagattgacttacaaggacctgaagtgggatatttcagtcaaatgaaaatcatctctgaaaatgtgcccagttacaaaactcatgaatctcttactttacctcggagaactcatgacagtgagaagccctatgaatacaaggaatatgagaaggtcttcagttgtgacttagagtttgatgaatatcagaaaatacatactggtggaaaaaactatgaatgtaatcaatgttggaaaacctttgggatagataactccagtatgttacaactgaatattcatactggtgtgaaaccttgtaaatatatggaatatgggaatacatgtagtttttataaagactttaatgtataccagaaaattcataatgagaagttctataaatgtaaggaatacagaaggacctttgaaagagttggaaaagttactccacttcaaagagttcatgatggtgagaaacactttgaatgctcattctgtgggaaatcctttagagtgcatgcacaacttactcgacatcagaaaatccatactgatgagaaaacttacaaatgtatggaatgtggcaaggacttcagatttcattcacagcttaccgaacatcagagaattcatactggtgagaaaccctacaaatgtatgcactgtgagaaggtttttagaattagttcacagctcattgaacatcagagaattcacactggtgagaaaccttatgcatgtaaggaatgtgggaaggcttttggagtatgtagagaacttgctcgtcatcagagaattcatactggtaagaaaccctatgaatgcaaagcatgtggaaaggtctttagaaatagttcatccctgactagacatcagaggattcatactggtgaaaaaccctataaatgtaaagaatgtgagaaagcatttggagtaggtagtgaacttactcgacatgaaagaattcacagtggtcaaaaaccttatgaatgtaaggagtgtggaaagttctttagacttacgtcagcccttattcaacatcaaagaattcatagtggtgagaaaccttatgaatgtaaggtatgtgggaaggcctttagacatagttcagcccttacagaacatcagagaattcatactggagaaaaaccctatgaatgcaaggcatgtgggaaggcctttagacatagttcatcctttaccaaacatcagcgcattcatactgatgataaaccctatgaatgtaaggagtgtgggaattcctttagtgttgttgggcatcttacttgccaaccgaaaatttacactggtgagaaatcatttgactgaaataaatgtataaagtggttttttatttctgattttcacaggaaaatactgtggatggatttaataggtaatcaaggcaattcagtatctccctctcttaaagtctgtttttagacttcatggtcattctgtatgtagacgtagaattgcttagtcatagctgatatatacttatagctttgttagatgttgccaaatatttctcctttttatgttaaaaagtttttttcatgagtttctcatcctggcatgttttgtttacaatagcttttgatgtttgtattattgctcttttgactattcagttttttaattgtaatattacttcaatatcttttctgcattgtaattctttgcttgtgatatctatacttacttattttcctccacagagttagcactcctagtcagatacaatgtatttttacagtcttacagctcatcattttgtgtaatgttgttttgttttgttttaaatgatagaagtgtgatctcctttccattttcatccaattgttgacttctctttaaatttctactttattttgatacaacatattccccccaaaaaaacacatacataggaactggttatattccaccataacacacacacacacacacacacactatatacatatagtgtatatacacatatagtgtatatagtgtatgtgtgatgtatactatacatatcacatatactatatgtgtgtatatagtgtgtgatgtatatgtgtgtgatgtatactatatatgcccacacatgcactacataacacactatatatatatatatatatacacacacacacacacaatatatgtatatatagtatatacactatatactgggcactatatatatatagtgtgtatgtgtgttatattggaatataaccagttcctttaagcagtctttttacctgcaggctataccaaccaggatccaaatgaagagaactcttttaaatatttgataaaactactcacccagtaagtctcttaaaatttatcattctcttaaagtatcactctaaaatttgtcaaacacctttaaaaggggagaaaaaatgaccactgaacttacattaagagaatttacaactatatattaacatggcttcaattgtttttttaatctattatcattatttttctttttattccctctcagagttgacttactaggtttgggcatttcaacaatcagcagaccttctttggtttaactaatctcatttaactccaaaatcatctctctcttaggactgctgacttggttatgcagtcaatgagatcacgagccactggttattggattttttttctttttttttagacagagttttgctcttgttgcctaggctggagtgcagtggcgcagtcttggctcacctcaacctctgcctcccaggttcaggctattctcctgctcagcctcctgattagctgggattacaggcatgcgccaccatgaccggctaattttatatttttagtagagacgggatatctccgtgttggtcagtctggtctcaaactcccgacctcaggtgatccacccgcctcagcctcccaaagtgctgggattacaggcatgagccaccgcacccagcctggttattggatttatttatttattttgagatagagccttgctctgtcaccaggccggagtgcagtggtgtcatctcagatcactgcaacctccacctcccaggttcaagcgattcccctgcctcagcctgccaagtagctgggattacaggcatgcgccaccatgcccagctaattgtattttagtagatatggagtttcaccacgttggccaagacagtctcgatttcctgaccttgtgatccccctgcctcggcctcccaaagtgctgggattacaggcatgagccaccacgcctgtccggttatttgatttttataagaaaattttactattattttcagataaatttatgtcactgtcattcattacattttaatttttgaaactgatgtctttcccagaatttatgtactctataacggtgtgaatgattaccagtattaagccattttctcatctgatatattgagctatgttttatgtaagtattgcttattcaagtagttttaaaagatatgtaattggttgttgtttcatgtcctacacagtaagaacaagagtatgttaacctttttgtcaggatatttgctatttcatatctttgaaatagagtagtagctctatttctaactaaattctatttatgtaacaacacagctaatttactcttggatctcattctccctttttatcctgagttaccatcagtgctaatgttcctcttttgggtatagttctccaggagaacttgtcctatatttctttgtgtgtgtttttttccttccagcttaaacaaattaaaactaaatatctaaaccttgtatacagacattaaaattagtgagagaaacaaaata

SEQ ID NO: 202812 - DNA, 587 bp, Homo sapiens
  Payload ID: 20002
  Gene Name: zinc finger protein 529
  ENST ID: ENST00000586115
  CDS Start-End: 332-587
gtctccggggcggcccgttagtcgccgcgcggtgctagctgccggcgctcccctccgtttgcacccacggccgccctattgcggctggcactacgcttctgccaggaccccggctcccttttccgttgacctggtgttcgttttccatgtgttgctgagagatggatgttaaaaatcaacaccaggactacagtaaggctgaaatcattgaagtgcttggagtgcagaactgaaagaggaactggtgacactcagggatgtggtcatcaacttctctcaggaggaatgggaatatctggattctgctcagaggaacttgtactgggatgtgatgatggagaactacagcaacttactctcactggatttggagtccaggaatgagactaagcatttatctgtaggaaaagatattattcaaaacactggttctcagtgggaggtaatggaaagtagcaagttatgtggccttgaaggttccattttcagaaatgactggcaaagcaaaagcaagattgacttacaaggacctgaagtgggatatttcagtcaaatgaaaatcatctctgaaaatgtgcccagttaca

SEQ ID NO: 202813 - DNA, 395 bp, Homo sapiens
  Payload ID: 20002
  Gene Name: zinc finger protein 529
  ENST ID: ENST00000452073
  CDS Start-End: 1-338
gagttggaaaagttactccacttcaaagagttcatgatggtgagaaacactttgaatgctcattctgtgggaaatcctttagagtgcatgcacaacttactcgacatcagaaaatccatactgatgagaaaacttacaaatgtatggaatgtggcaaggacttcagatttcattcacagcttaccgaacatcagagaattcatactgggaggctgaacaatctactgttggaggaagctgagaagaccatggaagggaaatggaagctgctcacatattccttccctcatgcaggtgtccatctttacctaagattcagttgtaggaagaagtcttaattttaaacagttcagagtactaattattgtaatataccaggtatttcatttagcaaa

SEQ ID NO: 202814 - DNA, 535 bp, Homo sapiens
  Payload ID: 20002
  Gene Name: zinc finger protein 529
  ENST ID: ENST00000585960
  CDS Start-End: 260-535
agtcgccgcgcggtgctagctgccggcgctcccctccgtttgcacccacggccgccctattgcggctggcactacgcttctgccaggaccccggctcccttttccgttgacctggtgttcgttttccatgtgttgctgagagatggatgttaaaaatcaacaccaggactacagtaaggctgaaatcattgaagtgcttggagtgcagaactgaaagagtttcattggggatcatgtccatggagctcctcatgctgtcatgccagaagtggaattccctgaccaattctttacagttctaaccatggaccatgaactggtgacactcagggatgtggtcatcaacttctctcaggaggaatgggaatatctggattctgctcagaggaacttgtactgggatgtgatgatggagaactacagcaacttactctcactggatttggagtccaggaatgagactaagcatttatctgtaggaaaagatattattcaaaacactggttctcagtgggaggtaatggaaagtagcaag

SEQ ID NO: 202815 - DNA, 419 bp, Homo sapiens
  Payload ID: 20002
  Gene Name: zinc finger protein 529
  ENST ID: ENST00000590656
  CDS Start-End: 1-219
gagaaggtttttagaattagttcacagctcattgaacatcagagaattcacactggtgagaaaccttatgcatgtaaggaatgtgggaaggcttttggagtatgtagagaacttgctcgtcatcagagaattcatactggctataccaaccaggatccaaatgaagagaactcttttaaatatttgataaaactactcacccaggcaatgaggacataagaatgtgattctaatttgatacaaatggtgatcttatgagaagaggaaggagagacgtctcttcctatgctcacacacaaaggaaagtccacatgaggacacaaggagaagccaagagagcccttaccaggaattaaacctgctaatccctattttaattagaacagtgagaaaataaatatctgtatttaagcctcaca

SEQ ID NO: 202816 - DNA, 582 bp, Homo sapiens
  Payload ID: 20002
  Gene Name: zinc finger protein 529
  ENST ID: ENST00000585983
  CDS Start-End: 252-582
gctagctgccggcgctcccctccgtttgcacccacggccgccctattgcggctggcactacgcttctgccaggaccccggctcccttttccgttgacctggtgttcgttttccatgtgttgctgagagatggatgttaaaaatcaacaccaggactacagtaaggctgaaatcattgaagtgcttggagtgcagaactgaaagagttctgcaagtgaaggccccctgaagtggaagacagcattggtactaatggccaactcaagtttcattggggatcatgtccatggagctcctcatgctgtcatgccagaagtggaattccctgaccaattctttacagttctaaccatggaccatgaactggtgacactcagggatgtggtcatcaacttctctcaggaggaatgggaatatctggattctgctcagaggaacttgtactgggatgtgatgatggagaactacagcaacttactctcactggatttggagtccaggaatgagactaagcatttatctgtaggaaaagatattattcaaaacactggttctcagtgggaggtaatggaaagtagcaagt

SEQ ID NO: 202817 - DNA, 2962 bp, Homo sapiens
  Payload ID: 20003
  Gene Name: zinc finger protein 530
  Uniprot ID: Q6P9A1
  ENST ID: ENST00000332854
  CDS Start-End: 221-2020
ggaacttccggcgtcctccctgtggcgggcactttggcttgtgtcagttccatccgcgggtgccggatctggacctaggtgctgacagcgagaaggcgcgaggagagtcgttttctcagctgcacagccggggcctgacggtcgccggcggtggtgacagctttgctcttgtctccgcccggatcgtccaccgctcccggcccgctccgcccagagtccgatggcggcggcactgagggccccgacccagcaggtttttgtagcctttgaggatgtggccatttacttctcccaggaggagtgggagctccttgatgagatgcagaggctcctgtaccgcgatgtgatgctggagaactttgcagttatggcatccctaggttgctggtgtggagcagtagatgaggggacgccttctgcagagagcgtttctgtggaagaactgtcacagggcaggactccaaaggcagatacatccactgataagagtcacccctgtgagatttgtaccccagtcctgagagacattttacaaatgattgagctccatgcctcaccctgtggacagaaattgtacttgggtggagcatcaagagatttctggatgagttcaaaccttcaccagctccagaagcttgataatggagagaagctctttaaagtggatggggaccaggcctcatttatgatgaactgcaggttccatgtgtcaggaaaacccttcacgtttggggaagtcgggagggacttttcagccacctcaggacttctccagcatcaggtgactcccaccattgagagaccacacagcaggattagacacttgagagttcccactggacgaaagcctctcaaatacactgaatccaggaaatcttttagagagaaatctgtattcattcaacaccaaagagctgactctggagaaaggccttacaagtgcagtgaatgtgggaaatcctttagtcaaagttctggctttcttcgacacaggaaagcacacggtagaacaaggactcatgaatgtagtgaatgtgggaaatcatttagtcgcaaaactcacctaactcaacaccaaagagttcacactggagaaaggccttatgactgcagtgaatgtggcaaatcctttcgccaggtatctgtcctcattcaacatcaacgagttcacactggagaaaggccttatgagtgcagtgaatgtgggaaatcttttagccacagcactaacctctatcgtcacaggagtgcccacactagcacaaggccttatgagtgcagtgaatgtggaaaatcctttagccatagcactaacctctttcgacactggagagttcacactggagtaaggccttatgagtgtagtgaatgtgggaaagcatttagttgcaatatctaccttattcaccaccaaagatttcacactggagaaagaccttatgtgtgcagtgaatgtgggaaatcatttggccagaaatctgtcctcattcaacaccaaagagttcacactggagaaaggccttatgagtgcagtgaatgtgggaaagtttttagccaaagctctggcctctttcgacacagaagagctcacactaaaacaaagccttatgagtgcagtgaatgtgaaaaatcatttagttgcaaaactgacctcattcgacaccagacagttcacactggagaaaggccttatgagtgcagtgtatgtgggaaatcttttatccgaaaaacccacctcattcgacaccagactgttcacactaatgaaaggccttatgagtgcgatgaatgtgggaaatcctatagccaaagctctgccctccttcagcataggagagttcacactggagaaaggccttatgagtgcagagaatgtgggaaatcttttacccgcaaaaatcacctcattcaacacaagacagttcacactggagaaaggccttatgaatgcagtgaatgtggaaaatcctttagccaaagctctggcctcttaagacacagaagagttcatgtgcagtgaatgtgggaaattattttgtcacttttttttttttttttgagatggaattttgctcgtcacccaggctggagtgcaattgtgcaatctcagctcactgcaacctccgcctcctgggatcaagtgattctcctgccacagcctcctgagtacctgagattacaggcacccaccaccatgcccagctaatttttgtatttttaatagaaacaaggtttcaccatgttggtcaggctggtgttgaactcctgacctcaggtaatccacctgcttcagcctaccaaagtgctgggattacaggcgtgagccaccatgtccggcttgtgttgtgacatttaacacaagatttcccaaagaagaaaggccttatatatgctgtgaatgtgtttttgcttgttagtttgttttaacttggtatgacggcactggaggctagcctttgagaagagccttctctgatgtgactcatgtatccaaacatccatggatttcccataaatttgaggtatgtgggaagcatgtgtagctatgttgtactctctaaacctgcccagggaccttaccagattcgtgtcactgccagtttctgcggctgaagccttttcatcactacccgctgggagacccacagagtgtgcatcagtcaccaccccaacatgctcagggaggcagagttcttccattagttggaggaaagcacgagtagtctaagctcttaggggggtttctcatttcctcctgtggctacatagtgcatataactaccccagtgttggccccaggacctgatctgagttctgctggcagcttccagaggattgccttttttgaggacattgttgatctcaggcgatgcttgtgatgaagcattttttagcttccaccacttaccaggaactgcctgttaactggcttgtgcaatgataaaggccttttgtttaagta

SEQ ID NO: 202818 - DNA, 634 bp, Homo sapiens
  Payload ID: 20003
  Gene Name: zinc finger protein 530
  ENST ID: ENST00000597864
  CDS Start-End: 354-440
cctgtggcgggcactttggcttgtgtcagttccatccgcgggtgccggatctggacctaggtgctgacagcgagaaggcgcgaggagagtcgttttctcagctgcacagccggggcctgacggtcgccggcggtggtgacagctttgctcttgtctccgcccggatcgtccaccgctcccggcccgctccgcccagagtccgatggcggcggcactgagggccccgacccagattgccactagtacttacaggtccgtaagaagcacttgaagaccctacaaggcaggtttttgtagcctttgaggatgtggccatttacttctcccaggaggagtgggagctccttgatgagatgcagaggctcctgtaccgcgatgtgatgctggagaactttgcagttatggcatccctaggtattattgagtgttttcaagaatgaaaagaggcctggcatggtggctcacatctgtaatcccaactttttgggaggctgaggtgggaggatcccttgagcccaagagtttgaggctgcagcaagctatgatcgtgccactacactccagcctgtgcaacacagtgagatcctgtctccaaaattaaataaataaataaaattacattttggagactaaa

SEQ ID NO: 202819 - DNA, 469 bp, Homo sapiens
  Payload ID: 20003
  Gene Name: zinc finger protein 530
  ENST ID: ENST00000597700
  CDS Start-End: 372-469
ggaacttccggcgtcctccctgtggcgggcactttggcttgtgtcagttccatccgcgggtgccggatctggacctaggtgctgacagcgagaaggcgcgaggagagtcgttttctcagctgcacagccggggcctgacggtcgccggcggtggtgacagctttgctcttgtctccgcccggatcgtccaccgctcccggcccgctccgcccagagtccgatggcggcggcactgagggccccgacccagattgccactagtacttacaggtccgtaagaagcacttgaagaccctacaaggcaggtttttgtagcctttgaggatgtggccatttacttctcccaggaggagtgggagctccttgatgagatgcagaggctcctgtaccgcgatgtgatgctggagaactttgcagttatggcatccctaggttgctggtgtggagcagtagatgaggggacgccttc

SEQ ID NO: 202820 - DNA, 2742 bp, Homo sapiens
  Payload ID: 20003
  Gene Name: zinc finger protein 530
  Uniprot ID: Q6P9A1
  ENST ID: ENST00000600619
  CDS Start-End: 221-2020
ggaacttccggcgtcctccctgtggcgggcactttggcttgtgtcagttccatccgcgggtgccggatctggacctaggtgctgacagcgagaaggcgcgaggagagtcgttttctcagctgcacagccggggcctgacggtcgccggcggtggtgacagctttgctcttgtctccgcccggatcgtccaccgctcccggcccgctccgcccagagtccgatggcggcggcactgagggccccgacccagcaggtttttgtagcctttgaggatgtggccatttacttctcccaggaggagtgggagctccttgatgagatgcagaggctcctgtaccgcgatgtgatgctggagaactttgcagttatggcatccctaggttgctggtgtggagcagtagatgaggggacgccttctgcagagagcgtttctgtggaagaactgtcacagggcaggactccaaaggcagatacatccactgataagagtcacccctgtgagatttgtaccccagtcctgagagacattttacaaatgattgagctccatgcctcaccctgtggacagaaattgtacttgggtggagcatcaagagatttctggatgagttcaaaccttcaccagctccagaagcttgataatggagagaagctctttaaagtggatggggaccaggcctcatttatgatgaactgcaggttccatgtgtcaggaaaacccttcacgtttggggaagtcgggagggacttttcagccacctcaggacttctccagcatcaggtgactcccaccattgagagaccacacagcaggattagacacttgagagttcccactggacgaaagcctctcaaatacactgaatccaggaaatcttttagagagaaatctgtattcattcaacaccaaagagctgactctggagaaaggccttacaagtgcagtgaatgtgggaaatcctttagtcaaagttctggctttcttcgacacaggaaagcacacggtagaacaaggactcatgaatgtagtgaatgtgggaaatcatttagtcgcaaaactcacctaactcaacaccaaagagttcacactggagaaaggccttatgactgcagtgaatgtggcaaatcctttcgccaggtatctgtcctcattcaacatcaacgagttcacactggagaaaggccttatgagtgcagtgaatgtgggaaatcttttagccacagcactaacctctatcgtcacaggagtgcccacactagcacaaggccttatgagtgcagtgaatgtggaaaatcctttagccatagcactaacctctttcgacactggagagttcacactggagtaaggccttatgagtgtagtgaatgtgggaaagcatttagttgcaatatctaccttattcaccaccaaagatttcacactggagaaagaccttatgtgtgcagtgaatgtgggaaatcatttggccagaaatctgtcctcattcaacaccaaagagttcacactggagaaaggccttatgagtgcagtgaatgtgggaaagtttttagccaaagctctggcctctttcgacacagaagagctcacactaaaacaaagccttatgagtgcagtgaatgtgaaaaatcatttagttgcaaaactgacctcattcgacaccagacagttcacactggagaaaggccttatgagtgcagtgtatgtgggaaatcttttatccgaaaaacccacctcattcgacaccagactgttcacactaatgaaaggccttatgagtgcgatgaatgtgggaaatcctatagccaaagctctgccctccttcagcataggagagttcacactggagaaaggccttatgagtgcagagaatgtgggaaatcttttacccgcaaaaatcacctcattcaacacaagacagttcacactggagaaaggccttatgaatgcagtgaatgtggaaaatcctttagccaaagctctggcctcttaagacacagaagagttcatgtgcagtgaatgtgggaaattattttgtcacttttttttttttttttgagatggaattttgctcgtcacccaggctggagtgcaattgtgcaatctcagctcactgcaacctccgcctcctgggatcaagtgattctcctgccacagcctcctgagtacctgagattacaggcacccaccaccatgcccagctaatttttgtatttttaatagaaacaaggtttcaccatgttggtcaggctggtgttgaactcctgacctcaggtaatccacctgcttcagcctaccaaagtgctgggattacaggcgtgagccaccatgtccggcttgtgttgtgacatttaacacaagatttcccaaagaagaaaggccttatatatgctgtgaatgtgtttttgcttgttagtttgttttaacttggtatgacggcactggaggctagcctttgagaagagccttctctgatgtgactcatgtatccaaacatccatggatttcccataaatttgaggtattattgagtgttttcaagaatgaaaagaggcctggcatggtggctcacatctgtaatcccaactttttgggaggctgaggtgggaggatcccttgagcccaagagtttgaggctgcagcaagctatgatcgtgccactacactccagcctgtgcaacacagtgagatcctgtctccaaaattaaataaataaataaaattacattttggagactaaa

SEQ ID NO: 202821 - DNA, 6696 bp, Homo sapiens
  Payload ID: 20004
  Gene Name: zinc finger protein 532
  Uniprot ID: Q9HCE3
  ENST ID: ENST00000336078
  CDS Start-End: 777-4682
tctcgcccttgcacgggtcacgattatacaccttcgtgacctttagcgggcttacatatgtatctttttgtgttccgcaggctatgaccacctgctgtatgtacaatatgtgcttgttacatttgtacaccatctcccttctagaatttaaagacctagctattacatcttgtttactcaatatcattcccccattaaggaaaaaaaaaaacctacatgaactgaacatgccatgtttcaatctggccccagtggctttttctctgaaagcaaacgtgtgtcttttacaccagggctttctccccaccccagggggtgtcttccatccttttgtggctcagttgaaggcgaaaagggctccaaaccactaactaaccagaggagagccccttcttccacctccagggagaatttcagatttaatttgtccgaagatagcgtgctctcttcttactcatttgccatcattacgaggaaaacaaaccaccaccttggcttcaagatcctgggtagaggctcacggtcttttcaaccatctttggcgaggccttgcttccttccactcgaggtatgttctgtcttgtgctttttcttttagaagctactaaagggtgttggggatgcttctgactattatgaaggccaaaaggcctgttgactggggctgcttttaaccctttcctatttgctgagaatgcagccgtgtgacagtaactg[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttggcccttgtgcttctgtgagagaattattgatggtgggtctctgacatctttgtgaagtttgggaagtaattaattgcagcgacaagctacagggtgttgcagaattcttcccactcagaagaatggcatattcgttctcattagtaatcagctattttgtcactttcttgttgactccatcagtacatgggtacaatccgagggtgtgaatttcagcttgaaattccattgctgttccttgttttgtttgtattgctctaagttgtattcataatagcactttcatatgtttctgcatttgaaccttgcaataagcctgtgtggtaggccacataggtccgaataacctagttttacagttgagggagctgagctcagattcagttctttgccgaagccctcatagctggtaagtggctttgcatattagaacccaaatattttgctctctaaatctaatgctcgctctatgtggttatgtacatattgacaaatattcatttattcaacaaataaaaagtatgtacaaaacatga

SEQ ID NO: 202822 - DNA, 372 bp, Homo sapiens
  Payload ID: 20004
  Gene Name: zinc finger protein 532
  ENST ID: ENST00000586997
  CDS Start-End: 1-372
ccctccaaactgtgtagacatagtctaaaatgtttggagtgtaatgaagtcttccaggacgagacatcactggctacacatttccagcaggctgcagatacgagtggacaacaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaag

SEQ ID NO: 202823 - DNA, 676 bp, Homo sapiens
  Payload ID: 20004
  Gene Name: zinc finger protein 532
  ENST ID: ENST00000588601
  CDS Start-End: 396-676
gttcgctcgccgcccgggccgagccgccgccgccgccgccgcccggcccggcggcgaggccgctccaccgcacacgcacacacagaccccggcagcgggaacgcagatgacacgcccgtaacatggaagccgccgccgccgccgctccgacgacagcagcagcagccacagcagcagccgccggcggcgccgcgctgaacaaaggtcatccgagctgcggcccagacgcccgggcttgaccgccgcgaaggccaaccccgggaagggggcctgttgactggggctgcttttaaccctttcctatttgctgagaatgcagccgtgtgacagtaactg[340 bp omitted]

SEQ ID NO: 202824 - DNA, 4450 bp, Homo sapiens
  Payload ID: 20004
  Gene Name: zinc finger protein 532
  Uniprot ID: Q9HCE3
  ENST ID: ENST00000591230
  CDS Start-End: 355-4260
acagatgcgtttccagaggcctccgtgccccctctcccactggccctgccttcgccccccgccccctccccagacagccccagttttcttcccccgaggtgaagggatttggacttctccccccaggtgcttgaaagaagagaagggtatgttctgtcttgtgctttttcttttagaagctactaaagggtgttggggatgcttctgactattatgaaggccaaaaggcctgttgactggggctgcttttaaccctttcctatttgctgagaatgcagccgtgtgacagtaactg[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaa

SEQ ID NO: 202825 - DNA, 578 bp, Homo sapiens
  Payload ID: 20004
  Gene Name: zinc finger protein 532
  ENST ID: ENST00000590285
  CDS Start-End: 335-578
acacagaccccggcagcgggaacgcagatgacacgcccgtaacatggaagccgccgccgccgccgctccgacgacagcagcagcagccacagcagcagccgccggcggcgccgcgctgaacaaagggtatgttctgtcttgtgctttttcttttagaagctactaaagggtgttggggatgcttctgactattatgaaggccaaaaggcctgttgactggggctgcttttaaccctttcctatttgctgagaatgcagccgtgtgacagtaactg[303 bp omitted]

SEQ ID NO: 202826 - DNA, 649 bp, Homo sapiens [sequence omitted]

SEQ ID NO: 202827 - DNA, 591 bp, Homo sapiens [sequence omitted]

SEQ ID NO: 202828 - DNA, 5585 bp, Homo sapiens
  Payload ID: 20004
  Gene Name: zinc finger protein 532
  Uniprot ID: Q9HCE3
  ENST ID: ENST00000589288
  CDS Start-End: 202-4107
cgccgccgccgccgctccgacgacagcagcagcagccacagcagcagccgccggcggcgccgcgctgaacaaaggcctgttgactggggctgcttttaaccctttcctatttgctgagaatgcagccgtgtgacagtaactg[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttg

SEQ ID NO: 202829 - DNA, 560 bp, Homo sapiens
  Payload ID: 20004
  Gene Name: zinc finger protein 532
  ENST ID: ENST00000590157
  CDS Start-End: 1-355
tttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaatggaatggagccagcacggtggctcacacctgtagtcccagcactttgagaggccaaggcaggaggatggcttgaggccaggagtttgagagcagccttgacaatatgaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaa

SEQ ID NO: 202830 - DNA, 561 bp, Homo sapiens
  Payload ID: 20004
  Gene Name: zinc finger protein 532
  ENST ID: ENST00000586085
  CDS Start-End: 357-561
catggaagccgccgccgccgccgctccgacgacagcagcagcagccacagcagcagccgccggcggcgccgcgctgaacaaaggtcatccgagctgcggcccagacgcccgggcttgaccgccgcgaaggccaaccccgggaaggggggtatgttctgtcttgtgctttttcttttagaagctactaaagggtgttggggatgcttctgactattatgaaggccaaaaggcctgttgactggggctgcttttaaccctttcctatttgctgagaatgcagccgtgtgacagtaactg[264 bp omitted]

SEQ ID NO: 202831 - DNA, 539 bp, Homo sapiens
  Payload ID: 20004
  Gene Name: zinc finger protein 532
  ENST ID: ENST00000589156
  CDS Start-End: 1-351
aagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaatggaatggagccagcacggtggctcacacctgtagtcccagcactttgagaggccaaggcaggaggatggcttgaggccaggagtttgagagcagccttgacaatatggaacactgtctgctttttagattttctttccattttctaccgttctaaagtagtgcaatcacattactttagataaaagagaagcagcaggggaggggactcacctctactctgacatgccgtggtcat

SEQ ID NO: 202832 - DNA, 569 bp, Homo sapiens [sequence omitted]

SEQ ID NO: 202833 - DNA, 672 bp, Homo sapiens [sequence omitted]

SEQ ID NO: 202834 - DNA, 598 bp, Homo sapiens
  Payload ID: 20004
  Gene Name: zinc finger protein 532
  ENST ID: ENST00000585662
  CDS Start-End: 1-388
ttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagtgggaagaggaaccacatcctttaacttccagtagaagctctgtaactccaagtcactgaaaaatctgagtcacatatgtatatcctttctcttttaaatacaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacg

SEQ ID NO: 202835 - DNA, 583 bp, Homo sapiens [sequence omitted]

SEQ ID NO: 202836 - DNA, 490 bp, Homo sapiens
  Payload ID: 20004
  Gene Name: zinc finger protein 532
  ENST ID: ENST00000588543
  CDS Start-End: 271-490
agatgcgtttccagaggcctccgtgccccctctcccactggccctgccttcgccccccgccccctccccagacagccccagttttcttcccccgaggtgaagggatttggacttctccccccaggtgcttgaaagaagagaaggcctgttgactggggctgcttttaaccctttcctatttgctgagaatgcagccgtgtgacagtaactg[279 bp omitted]

SEQ ID NO: 202837 - DNA, 5171 bp, Homo sapiens
  Payload ID: 20004
  Gene Name: zinc finger protein 532
  Uniprot ID: Q9HCE3
  ENST ID: ENST00000591808
  CDS Start-End: 890-4795
cttgcgaggtgagcatttccaaggctgtgtgctcgtggggtggggggacacacgatgaccttctcctcctcaggaagacctaagagggaagagcaaaccccagcgagatcccccctgtgctgatgattttcagggacttgttggcaactcagcgagggttgccatagcttttttatgtagggtgaccagaaccggctgaaactggtttgaggcagatcagctcctgaacacaatgcagtcactgagctactacagtaggatagcagcttcctcccttcatggcagccaaaagcagaggagcttgcaggaaggtaccatccctacacagtatgtgaatgcacacttagacaccacacagcactggtacgtgactaatggagccctaaaagattctgggtagagaagatggaaaaaaaggtgcaggtttgcagggtctgagattacttgggcttttcctgcctttttcttttgcttaagggatggacaaggagctgagatttatgacccttattagagaaaaaaatgtgccttgctagggtggggacacttggttgatgcagtctctctctctctttctcggtgtttataacaaaacaaaaccaaaatgaactgaggggtttgtaatggtagtttgtttgttgctggagaatgctactttgcatgctttttttctcttgcagggtatgttctgtcttgtgctttttcttttagaagctactaaagggtgttggggatgcttctgactattatgaaggccaaaaggcctgttgactggggctgcttttaaccctttcctatttgctgagaatgcagccgtgtgacagtaactg[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttgga

SEQ ID NO: 202838 - DNA, 5324 bp, Homo sapiens
  Payload ID: 20004
  Gene Name: zinc finger protein 532
  Uniprot ID: Q9HCE3
  ENST ID: ENST00000591083
  CDS Start-End: 347-4252
cgaaaagggctccaaaccactaactaaccagaggagagccccttcttccacctccagggagaatttcagatttaatttgtccgaagatagcgtgctctcttcttactcatttgccatcattacgaggaaaacaaaccaccaccttggcttcaagatcctgggtagaggctcacggtcttttcaaccatctttggcgaggccttgcttccttccactcgagcctgttgactggggctgcttttaaccctttcctatttgctgagaatgcagccgtgtgacagtaactg[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgc

SEQ ID NO: 202839 - DNA, 562 bp, Homo sapiens [sequence omitted]

SEQ ID NO: 202840 - DNA, 1525 bp, Homo sapiens
  Payload ID: 20005
  Gene Name: zinc finger protein 534
  ENST ID: ENST00000301085
  CDS Start-End: 126-707
gctttttcctgtagacccggcacccgactgcgcggaaagactgtctaagccgccactcgattcactttcaaagagacatattatgcaaggaagcaactcggaagaggaaagaaaggaagtcaggaatggcccttactcaggggcaattgtcattcagcgatgtggccatagaattctctcaggaggagtggaaatgcctggaccctgggcagaaagctttatacagggacgtgatgttagagaactacaggaacctggtctccctaggaatctgtcttcctgacctgagtgttacctccatgttggagcaaaagagagatccctggactctgcagagtgaagtgaaaataataaacaatccagatggcagggagtgcatcaaaggtgtgaacacagatttttcacttctggcctgggacgcgcgcgtcttcagggtggaagcctggcgcgcgtccggaggtgctgaggagccaaccggcccaaactttgtgggaaatgactcccctctgccctcgcccctcgctctgctaccatttccttccgtttctgcttcgcttggcgatgcaaaacgcgcgaggctcacggcagagggccgaggccacgggactctcagggccgggcccgcccctcggccgcgcagtgcggcgccgcacgccccggacgctgtccagcgttggccgcctgagcagaggctgccgcggagctaagacacccgccgtttcacccagccagcgggcccagcccgcggaggagggcggcatgcagctccgcgttgcctggctctccgggcacgcgggctacgatctgtacagtgcctgtgattacacaccaccacctatggagaaggctcttgtgaaaacggacattcagacagcgcttccttctggatgttatggagagtagctccaaggtctggcttggctgcaaaacactttgttgatgtaggagctggtatcacagatgaagattatagaggaaatgttggtgttgtactctttaatttttgcaaagaaaagtttgaagtcaaaaaaaggtgatcgaattgcacagctcatttgtgaacggattttttaatccagaaatagaagaagttcaagctttggatgacaccaaaaggggatcaggaggttttggctctaccggaaagaattaaaatttatgccaagaacagaaaacgagaagtcatacctttttcttaaaaacaaagagtttttgcttaaagtgttttggtgttttacacttctgtaaacttactagctttaccttctaaaagtactgcattttttttttatgatcaaagaagagatcatttaaaaaaagcatttctttgtgtttggatcacaaagaaactttgtttttctgcagttgatggttatttgtaaatctactttgtggtgacctgatgtaaacagtgtcttcttaaatgtacatcaattacagattaaaaaaaaaatcctgtattatttaactcaagaaatgataccccttcagcaacttaaaaaaaaaagtttgtttttgttttgtg

SEQ ID NO: 202841 - DNA, 2086 bp, Homo sapiens
  Payload ID: 20005
  Gene Name: zinc finger protein 534
  Uniprot ID: Q76KX8
  ENST ID: ENST00000332323
  CDS Start-End: 62-2086
ctttcaaagagacatattatgcaaggaagcaactcggaagaggaaagaaaggaagtcaggaatggcccttactcaggggcaattgtcattcagcgatgtggccatagaattctctcaggaggagtggaaatgcctggaccctgggcagaaagctttatacagggacgtgatgttagagaactacaggaacctggtctccctaggtgaggataatgtccgtccagaagcctgcatctgctctggaatctgtcttcctgacctgagtgttacctccatgttggagcaaaagagagatccctggactctgcagagtgaagtgaaaataataaacaatccagatggcagggagtgcatcaaaggtgtgaacacagagaagagttctaaattgggaagcagtgcaggaaacaagtcacttaaaaatcaacatggattaactcttcagttacatctgactgaatggcagccatttcaagctgtaaggaatatttatggatgtaagcatgttgagaaatctatcagtgacaattcttcagtttcaccagttcaaataagttttttcagtgtcaaaacccatatttttaataactacagaaatgattttcttttttctacattactcccacaagaacagaaagtacacattagggaaaagccttatggatgtaatgagcatgggaaagtcttcagagtgtcttcaagccttactaaccgtcaagtaatccacattgcagataaaacttacaaatgtagtgactgtggcgagatctttagtagcaattcaaactttgcacaacatcaacgaatccatactggagagaagccttacaaatataatgaatgtggcaaagtcttcaatcagaattcacaccttgcacaacatcagaaaattcatactggacagaaaccttacaataacaaagaatgtgggaaagtctttagtcaccatgcctaccttgcacagcataggaaaattcatactggagagaagccttacaaatgtagtgaatgtggcaaagcatttagtgtgtgttccagtcttactgctcatcttgtaatccatactggagagaaaccttatgattgtaaggaatgtggcaaggtcttcaggcataagtcttccctaaccactcatcagacagttcatactggagagagaccatacaaatgtaatgaatgtggcaaggggtttagtcgaattgcattccttgcaaggcatcggaaagttcatactggagagaaaccttacaaatgtaatgagtgtggcaaggtctttattggcaattcacgccttgcacgacataggaaaattcatactggggggaggcgttacaaatgtaatgaatgtggcaaagcatttagaacgtgttcagatctcactgcccatcttctaatccatactggagagaaaccttacgaatgtatagactgtggcaaggtcttcaggcacaagtcttccctaacctatcactgtagaattcatactggagagaagccttacaaatgtaacgaatgtggcaaggtcttcagtcagaattcaaaccttcaacgacataggaaaattcatactggagagaagctttacaaatgtaatgaatgtggcaaggtcttccgtcagaattcacaccttgcacaacatagggatattcatactggagagaagccttacagttgtaatgaatgtggcaaggtcttccgtcggaattcacaccttgtgcgacataggaatgttcatactggagaaaagccttacagttgtaatgaatgtggcaaggtcttcagtcggaattcacaccttgcgcgacataggaatattcatactggagagaagcctcacagttgtaatgaatgtggcaaggtcttcagtcggaattcacaccttgcgcgacataggaaaattcatactggagagaagctttacaaatgtaatgaatgtagcaaggtcttcagtcggaattcacgccttgcacaacataggaatattcatactggagtgaagccttacagttgtaatgaatgtggcaaggtctttagtaaaaattccatcctagtacaacattgcagtattcataccagagagaagccttaa

SEQ ID NO: 202842 - DNA, 2047 bp, Homo sapiens
  Payload ID: 20005
  Gene Name: zinc finger protein 534
  Uniprot ID: Q76KX8
  ENST ID: ENST00000433050
  CDS Start-End: 62-2047
ctttcaaagagacatattatgcaaggaagcaactcggaagaggaaagaaaggaagtcaggaatggcccttactcaggggcaattgtcattcagcgatgtggccatagaattctctcaggaggagtggaaatgcctggaccctgggcagaaagctttatacagggacgtgatgttagagaactacaggaacctggtctccctaggaatctgtcttcctgacctgagtgttacctccatgttggagcaaaagagagatccctggactctgcagagtgaagtgaaaataataaacaatccagatggcagggagtgcatcaaaggtgtgaacacagagaagagttctaaattgggaagcagtgcaggaaacaagtcacttaaaaatcaacatggattaactcttcagttacatctgactgaatggcagccatttcaagctgtaaggaatatttatggatgtaagcatgttgagaaatctatcagtgacaattcttcagtttcaccagttcaaataagttttttcagtgtcaaaacccatatttttaataactacagaaatgattttcttttttctacattactcccacaagaacagaaagtacacattagggaaaagccttatggatgtaatgagcatgggaaagtcttcagagtgtcttcaagccttactaaccgtcaagtaatccacattgcagataaaacttacaaatgtagtgactgtggcgagatctttagtagcaattcaaactttgcacaacatcaacgaatccatactggagagaagccttacaaatataatgaatgtggcaaagtcttcaatcagaattcacaccttgcacaacatcagaaaattcatactggacagaaaccttacaataacaaagaatgtgggaaagtctttagtcaccatgcctaccttgcacagcataggaaaattcatactggagagaagccttacaaatgtagtgaatgtggcaaagcatttagtgtgtgttccagtcttactgctcatcttgtaatccatactggagagaaaccttatgattgtaaggaatgtggcaaggtcttcaggcataagtcttccctaaccactcatcagacagttcatactggagagagaccatacaaatgtaatgaatgtggcaaggggtttagtcgaattgcattccttgcaaggcatcggaaagttcatactggagagaaaccttacaaatgtaatgagtgtggcaaggtctttattggcaattcacgccttgcacgacataggaaaattcatactggggggaggcgttacaaatgtaatgaatgtggcaaagcatttagaacgtgttcagatctcactgcccatcttctaatccatactggagagaaaccttacgaatgtatagactgtggcaaggtcttcaggcacaagtcttccctaacctatcactgtagaattcatactggagagaagccttacaaatgtaacgaatgtggcaaggtcttcagtcagaattcaaaccttcaacgacataggaaaattcatactggagagaagctttacaaatgtaatgaatgtggcaaggtcttccgtcagaattcacaccttgcacaacatagggatattcatactggagagaagccttacagttgtaatgaatgtggcaaggtcttccgtcggaattcacaccttgtgcgacataggaatgttcatactggagaaaagccttacagttgtaatgaatgtggcaaggtcttcagtcggaattcacaccttgcgcgacataggaatattcatactggagagaagcctcacagttgtaatgaatgtggcaaggtcttcagtcggaattcacaccttgcgcgacataggaaaattcatactggagagaagctttacaaatgtaatgaatgtagcaaggtcttcagtcggaattcacgccttgcacaacataggaatattcatactggagtgaagccttacagttgtaatgaatgtggcaaggtctttagtaaaaattccatcctagtacaacattgcagtattcataccagagagaagccttaa

SEQ ID NO: 202843 - DNA, 956 bp, Homo sapiens
  Payload ID: 20005
  Gene Name: zinc finger protein 534
  ENST ID: ENST00000432303
  CDS Start-End: 62-514
ctttcaaagagacatattatgcaaggaagcaactcggaagaggaaagaaaggaagtcaggaatggcccttactcaggggcaattgtcattcagcgatgtggccatagaattctctcaggaggagtggaaatgcctggaccctgggcagaaagctttatacagggacgtgatgttagagaactacaggaacctggtctccctagatttttcacttctggcctgggacgcgcgcgtcttcagggtggaagcctggcgcgcgtccggaggtgctgaggagccaaccggcccaaactttgtgggaaatgactcccctctgccctcgcccctcgctctgctaccatttccttccgtttctgcttcgcttggcgatgcaaaacgcgcgaggctcacggcagagggccgaggccacgggactctcagggccgggcccgcccctcggccgcgcagtgcggcgccgcacgccccggacgctgtccagcgttggccgcctgagcagaggctgccgcggagctaagacacccgccgtttcacccagccagcgggcccagcccgcggaggagggcggcatgcagctccgcgttgcctggctctccgggcacgcgggctacgatctgtacagtgcctgtgattacacaccaccacctatggagaaggctcttgtgaaaacggacattcagacagcgcttccttctggatgttatggagagtagctccaaggtctggcttggctgcaaaacactttgttgatgtaggagctggtatcacagatgaagattatagaggaaatgttggtgttgtactctttaatttttgcaaagaaaagtttgaagtcaaaaaaaggtgatcgaattgcacagctcatttgtgaacggattttttaatccagaaatagaagaagttcaagctttggatgacaccaaaaggggatcaggaggttttggctctaccggaaagaa

SEQ ID NO: 202844 - DNA, 1085 bp, Homo sapiens
  Payload ID: 20005
  Gene Name: zinc finger protein 534
  ENST ID: ENST00000617900
  CDS Start-End: 62-643
ctttcaaagagacatattatgcaaggaagcaactcggaagaggaaagaaaggaagtcaggaatggcccttactcaggggcaattgtcattcagcgatgtggccatagaattctctcaggaggagtggaaatgcctggaccctgggcagaaagctttatacagggacgtgatgttagagaactacaggaacctggtctccctaggaatctgtcttcctgacctgagtgttacctccatgttggagcaaaagagagatccctggactctgcagagtgaagtgaaaataataaacaatccagatggcagggagtgcatcaaaggtgtgaacacagatttttcacttctggcctgggacgcgcgcgtcttcagggtggaagcctggcgcgcgtccggaggtgctgaggagccaaccggcccaaactttgtgggaaatgactcccctctgccctcgcccctcgctctgctaccatttccttccgtttctgcttcgcttggcgatgcaaaacgcgcgaggctcacggcagagggccgaggccacgggactctcagggccgggcccgcccctcggccgcgcagtgcggcgccgcacgccccggacgctgtccagcgttggccgcctgagcagaggctgccgcggagctaagacacccgccgtttcacccagccagcgggcccagcccgcggaggagggcggcatgcagctccgcgttgcctggctctccgggcacgcgggctacgatctgtacagtgcctgtgattacacaccaccacctatggagaaggctcttgtgaaaacggacattcagacagcgcttccttctggatgttatggagagtagctccaaggtctggcttggctgcaaaacactttgttgatgtaggagctggtatcacagatgaagattatagaggaaatgttggtgttgtactctttaatttttgcaaagaaaagtttgaagtcaaaaaaaggtgatcgaattgcacagctcatttgtgaacggattttttaatccagaaatagaagaagttcaagctttggatgacaccaaaaggggatcaggaggttttggctctaccggaaagaa

SEQ ID NO: 202845 - DNA, 4945 bp, Homo sapiens
  Payload ID: 20006
  Gene Name: zinc finger protein 536
  Uniprot ID: O15090
  ENST ID: ENST00000355537
  CDS Start-End: 148-4050
gggaggtgagtctggagaagagagtttccacgttgtcatcataggatctggactcaagtgaccaaaaccttgcttggatttttacctgatgaagtttgtcttgaaaagtgaaaatggttccatttccattttccctgttctcaagggatggaagaagcgagcctgtgccttggagtgtcttcggcggagccggaagctgagccccacctgagtggccccgtcctcaacggccagtatgccatgagtcagaagctgcaccagatcacctcccagctcagccatgccttccccgagctccatccccggcccaaccccgaggagaagccccccgcatccctggaggagaaggcccacgtgcccatgagcggccagcccatgggcagtcagatggcgctcctggccaaccagctgggccgggaggtggacaccagcctcaacgggagggtggacttgcagcagttcctcaacgggcagaacctgggcatcatgtcccagatgagcgacatcgaggacgacgcccgcaagaaccgcaagtacccgtgcccactctgcggcaagcgcttccgcttcaacagcatcctctccctgcacatgcgcacgcacacgggcgagaagcccttcaagtgcccgtactgcgaccacagggcggcgcagaaggggaacctcaagattcacctgcggacccacaagctgggcaacctgggcaaggggcgtgggcgtgtgcgcgaggagaaccgcctgctgcacgagctggaggagcgcgccatcctgcgggacaagcagctgaaaggcagcctgctgcagccccggccggacctgaagcccccgccgcacgcccagcaggccccgctggccgcctgcaccctggccctgcaggctaaccacagcgttcccgacgtggcccacccggtgccctcgcccaagcctgccagcgtgcaggaggacgcggtggccccggcggcgggcttccgctgtaccttctgcaagggcaagttcaagaagcgcgaggagctggaccgccacatccgcatcttgcacaagccctacaagtgcacgttgtgcgacttcgcggcttcgcaggaggaggagctcatcagccacgtggagaaggcacacatcacggccgagtcggcccagggccagggccccaacggcggtggcgagcagtcggccaacgagttccgctgcgaggtgtgcggtcaggtgttcagccaggcgtggttcctcaagggtcacatgcgcaagcacaaagactcctttgagcactgctgccagatctgcggccggcgcttcaaggagccctggttcctcaagaaccacatgaaggtccacctcaacaagctgtcggtgaagaacaagtcccccagcgaccccgaggtgcctgtgcccatgggcggcatgtcccaggaggcccacgccaacctgtactccaggtacctctcctgcctgcagagtggcttcatgaccccggacaaagccggcctgagcgagcccagccagctctatggcaagggcgagctgcccatgaaggagaaggaagcgctggggaagctgctgtctcccatctccagcatggcccacggcgtcccggagggggacaagcactccctcctgggatgcctcaatctcgtgccgccgctgaaatccagctgcatcgagcggctgcaggcggctgccaaggctgcggagatggaccccgtgaacagctaccaggcttggcagctcatggccaggggcatggccatggaacatggcttcttgtctaaagagcatccgctgcagcgcaaccacgaagacactttggcaaacgccggggttctgtttgataaggagaagcgggagtacgtgttagtgggagcagatggctccaagcagaaaatgcctgctgatttggttcacagcactaaagtgggcagccagagagacctgccaagtaagctcgaccctttagaaagcagtcgggattttttgtcacacgggctgaaccagactctcgagtataacctgcagggtcctgggaacatgaaggagaagcccaccgagtgccccgactgcggccgggtgttccgcacttaccaccaggtggtcgtgcactcccgtgtccacaagcgggaccgcaagggcgaggaggatgggctgcacgtgggcctggatgagcggcgtggctcgggcagtgaccaggagtcccagtcggtgagccgctccaccacgccgggctcctctaacgtcaccgaggagagcggggtcggaggcggcctctcccagaccgggagtgcccaggaggacagcccgcacccctcctcgccatcctcctcagacattggcgaggaggctgggagatctgccggcgtccagcaaccagcgctgcttcgcgacagaagcctgggctcggccatgaaggactgcccgtactgtgggaaaactttccggacatcccatcaccttaaggtgcacctgaggatacacacaggtgagaaaccctacaagtgtccgcactgtgactatgccggcacgcagtcagcatccttaaaataccacttagagcgacaccatcgggagcggcagaacggggctgggccgctgtctgggcaacccccaaatcaagaccacaaggatgagatgtcaagcaaagcttctctgttcatcaggccagacatcctgaggggggccttcaagggtctccctggaatcgacttcagaggaggccctgcatctcagcagtggacatcaggggttctctcctctggagatcactcggggcaggccacgggcatgtcttcggaggtcccctcagatgctctgaaaggcactgaccttccttccaaaagcacccacttctctgagatcggaagagcttatcaaagcattgtgagcaacggtgtgaatttccaagggtccttgcaagctttcatggacagttttgtcctcagttccttgaagaaggagaaggacatgaaggacaaagccctggctgaccccccttccatgaaagtccacggagtggatggtggtgaggagaaacccagtggcaagtcctcccagaggaagtccgagaaatctcagtatgaacccctggacttgtctgtgcggccagatgccgcctccctcccgggctcctcggtaactgtgcaggacagcattgcatggcacggctgcttgttttgtgctttcacaacgtcctccatggagctcatggcccttcatctccaggccaaccacctgggcaaagcgaaacgcaaagataacaccatcggggtcacagtcaactgcaaagaccaagcccgggaggcgagtaagatggccctgctgccctcgttacaatcaaacaaagacctgggcctctccaatatgatcagctctctagactctgcttctgagaagatggcccaaggtcagctcaaggagactctgggagagcagaagagcggtgcatggaccggccacgtggaccctgcattttgtaacttcccatcagacttctacaagcagtttggtgtttacccaggcatggttggctcaggggcctccagttcctgccccaacaaggagcctgatggaaaggcccactctgaagaggatgtccccatcctgatccccgaaaccacgagtaagaacactactgatgacctctctgacattgcctcctcagaggacatggactcctccaagggggagaacaacgatgaagaggatgttgaaaccgaaccggaaatgatgaccaagccactgtctgccctcagcaaagacagcagcagcgatggcggggacagcctgcagcccacaggcacctcccagcccgtccagggactggtctcacctttatcccaagcaccggagaagcagtggcacagccagggtcttctccaagcccaggaccccttggcgggcctgccaaagccggagcgggggccccagagcctggacaagccgatgaacatgctgtcggtcctcagggcctacagttctgatggcttagcagcctttaacggacttgcaagtagcacagcaaattctggatgtatcaagaggccagacttgtgtggtaagtgacactccctgtcctagtcggtctatctggacttgcccttgtctgttcgtggtcctcggtggttatctgcagcttgttaatcgtgtaaagtcaagagaagaatgtatacacatatgtgtgttgaataattactattggcataggtatgtgtatacacacggtgcaccaatctacagtatatatagcagagaatcagaggctaaaaatattaccccatatgttccagtattagtcatggattgcaaaggcttagtaacttgagcaggagagaaaactccctcaaagtcataaatcctgagtgacaactgctgctggatgacagatcccttcacctgtggacaacctggctgggggtggggggctgttccaccagctcacctgagcatgtagaggtgggtcctgcagtggtctcgtgggtattactgcttgtgtctgattgtcctgtattttgtaacactttagaagaatacagaaaagtgcagtaattctctttctccatagtatttaagcagaaatattgctagtttaatattgtgtcaggtcgtcctattaaccaggagcagatgacagtaaaatttcagtgaatagcaccttgacatctacaacttaaaaatggtgattgaagcaaaatatgtaaacttgtacggggtgatcgtgtgctttggaacagagtattgttgaagtaattagaagatatattaaggtgttcctggtaatgaaggcatgtaagttataataattgtagctttctgaataagtgtcaaactatatctttaagtgtgctgtatgctgagttacaagttaggtcatttatgaatggaatgtaaaataatactaaaaatgcttcaataacttatcttggtattgctaataaaaaaaaaaagctgtgaaacatta

SEQ ID NO: 202846 - DNA, 655 bp, Homo sapiens
  Payload ID: 20006
  Gene Name: zinc finger protein 536
  ENST ID: ENST00000591488
  CDS Start-End: 240-655
agtccggagtccatttgcataattggattttttttttttgcctccttctttctccctgaaacttgtttgaaaacccaagtgaaaaccgcgacgatctgcacactcaaaagcaagtgccaaggaacggggacgccccctcttgcaatctgtcagtgcctgcaccaactttatcctttctggggcattttctcaccagactgacagtccttaagacaagtatgcagttaagctgctaagggatggaagaagcgagcctgtgccttggagtgtcttcggcggagccggaagctgagccccacctgagtggccccgtcctcaacggccagtatgccatgagtcagaagctgcaccagatcacctcccagctcagccatgccttccccgagctccatccccggcccaaccccgaggagaagccccccgcatccctggaggagaaggcccacgtgcccatgagcggccagcccatgggcagtcagatggcgctcctggccaaccagctgggccgggaggtggacaccagcctcaacgggagggtggacttgcagcagttcctcaacgggcagaacctgggcatcatgtcccagatgagcgacatcgaggacgacgcccgcaagaaccgcaagtacccgtgcccactctgcggcaagcgctt

SEQ ID NO: 202847 - DNA, 3198 bp, Homo sapiens
  Payload ID: 20006
  Gene Name: zinc finger protein 536
  ENST ID: ENST00000585628
  CDS Start-End: 350-3198
actcgtacagtagcggcgtcagatccatcccgcgcctcccagtccggagtccatttgcataattggattttttttttttgcctccttctttctccctgaaacttgtttgaaaacccaagtgaaaaccgcgacgatctgcacactcaaaagcaagtgccaattcctgaccaccacggctttaagaatatccttcaaccgggagggagatccattgctttaagacttgcctgggaacggggacgccccctcttgcaatctgtcagtgcctgcaccaactttatcctttctggggcattttctcaccagactgacagtccttaagacaagtatgcagttaagctgctaagggatggaagaagcgagcctgtgccttggagtgtcttcggcggagccggaagctgagccccacctgagtggccccgtcctcaacggccagtatgccatgagtcagaagctgcaccagatcacctcccagctcagccatgccttccccgagctccatccccggcccaaccccgaggagaagccccccgcatccctggaggagaaggcccacgtgcccatgagcggccagcccatgggcagtcagatggcgctcctggccaaccagctgggccgggaggtggacaccagcctcaacgggagggtggacttgcagcagttcctcaacgggcagaacctgggcatcatgtcccagatgagcgacatcgaggacgacgcccgcaagaaccgcaagtacccgtgcccactctgcggcaagcgcttccgcttcaacagcatcctctccctgcacatgcgcacgcacacgggcgagaagcccttcaagtgcccgtactgcgaccacagggcggcgcagaaggggaacctcaagattcacctgcggacccacaagctgggcaacctgggcaaggggcgtgggcgtgtgcgcgaggagaaccgcctgctgcacgagctggaggagcgcgccatcctgcgggacaagcagctgaaaggcagcctgctgcagccccggccggacctgaagcccccgccgcacgcccagcaggccccgctggccgcctgcaccctggccctgcaggctaaccacagcgttcccgacgtggcccacccggtgccctcgcccaagcctgccagcgtgcaggaggacgcggtggccccggcggcgggcttccgctgtaccttctgcaagggcaagttcaagaagcgcgaggagctggaccgccacatccgcatcttgcacaagccctacaagtgcacgttgtgcgacttcgcggcttcgcaggaggaggagctcatcagccacgtggagaaggcacacatcacggccgagtcggcccagggccagggccccaacggcggtggcgagcagtcggccaacgagttccgctgcgaggtgtgcggtcaggtgttcagccaggcgtggttcctcaagggtcacatgcgcaagcacaaagactcctttgagcactgctgccagatctgcggccggcgcttcaaggagccctggttcctcaagaaccacatgaaggtccacctcaacaagctgtcggtgaagaacaagtcccccagcgaccccgaggtgcctgtgcccatgggcggcatgtcccaggaggcccacgccaacctgtactccaggtacctctcctgcctgcagagtggcttcatgaccccggacaaagccggcctgagcgagcccagccagctctatggcaagggcgagctgcccatgaaggagaaggaagcgctggggaagctgctgtctcccatctccagcatggcccacggcgtcccggagggggacaagcactccctcctgggatgcctcaatctcgtgccgccgctgaaatccagctgcatcgagcggctgcaggcggctgccaaggctgcggagatggaccccgtgaacagctaccaggcttggcagctcatggccaggggcatggccatggaacatggcttcttgtctaaagagcatccgctgcagcgcaaccacgaagacactttggcaaacgccggggttctgtttgataaggagaagcgggagtacgtgttagtgggagcagatggctccaagcagaaaatgcctgctgatttggttcacagcactaaagtgggcagccagagagacctgccaagtaagctcgaccctttagaaagcagtcgggattttttgtcacacgggctgaaccagactctcgagtataacctgcagggtcctgggaacatgaaggagaagcccaccgagtgccccgactgcggccgggtgttccgcacttaccaccaggtggtcgtgcactcccgtgtccacaagcgggaccgcaagggcgaggaggatgggctgcacgtgggcctggatgagcggcgtggctcgggcagtgaccaggagtcccagtcggtgagccgctccaccacgccgggctcctctaacgtcaccgaggagagcggggtcggaggcggcctctcccagaccgggagtgcccaggaggacagcccgcacccctcctcgccatcctcctcagacattggcgaggaggctgggagatctgccggcgtccagcaaccagcgctgcttcgcgacagaagcctgggctcggccatgaaggactgcccgtactgtgggaaaactttccggacatcccatcaccttaaggtgcacctgaggatacacacaggtgagaaaccctacaagtgtccgcactgtgactatgccggcacgcagtcagcatccttaaaataccacttagagcgacaccatcgggagcggcagaacggggctgggccgctgtctgggcaacccccaaatcaagaccacaaggatgagatgtcaagcaaagcttctctgttcatcaggccagacatcctgaggggggccttcaagggtctccctggaatcgacttcagaggaggccctgcatctcagcagtggacatcaggggttctctcctctggagatcactcggggcaggccacgggcatgtcttcggaggtcccctcagatgctctgaaaggcactgaccttccttccaaaagcacccacttctctgagatcggaagagcttatcaaagcattgtgagcaacggtgtgaatttccaagggtccttgcaagctttcatggacagttttgtcctcagttccttgaagaaggagaaggacatgaaggacaaagccctggctgaccccccttccatgaaagtcca

SEQ ID NO: 202848 - DNA, 2951 bp, Homo sapiens
  Payload ID: 20006
  Gene Name: zinc finger protein 536
  ENST ID: ENST00000592773
  CDS Start-End: 1-414
gaccccttggcgggcctgccaaagccggagcgggggccccagagcctggacaagccgatgaacatgctgtcggtcctcagggcctacagttctgatggcttagcagcctttaacggacttgcaagtagcacagcaaattctggatgtatcaagaggccagacttgtgtggtcacaggcctttccagtgccgctactgtccctacagtgcctctcagaaggggaacctgaagacccatgtcctctgcgtccatcgcatgccttttgacaacagccagtatcccgaccgcaggttcaagcgctccagggtcgactcagaggcttctgggaatttcgaggagcctacagctgtcaaggcggggagctctgcagacctcacggaagagggcggcaagggccaggaggagaccaactgagcagaccaacctgtatattgcaatagtattttacacagttttaacattatgcatctggtaaaagtttgctaactgcattccaaggggaaaaaatcatgtacaaccccccaatagtgtatagaacatttaaaaaattttaaaagatatctatatatatattaaaaaaaaaaaattccccagcccttgaaaatggctgctaaactgttacccggcaacaagtacttccaaaacaatgcaggtgggagaaaagtgatttcaaaaattcttggtgccctctgagctggagagagctgggggcccttccaactcgaaagtcgtctttgtccaaaaataatgctcttaactgaaaaacgataccatctaaacgatttagtgttgcgttgaagatggaggggctgtgttttcgttgttgaaaacacctctataatctgacaccagctgctgtaattcgcctagaaccctaatgagatgtgtcgggaggcagctgcggtgccagtcagactggagcggtcactgcagagaaaatcaattcacgtggtgttgtaactgcactcttggagaaaccttagacggcccgcagccagcgccggggctgaccggcactgcagaggattgagatcttaaatgcgcatttttacaaaatacacagccaaatgaaatcaatgatcaggaagtgtctgcagacaaatgtccattgcaggtttgatgagtaattcctttttttagatcaaattgttctcggtagccttttcttcttttttaaaaaaaaattttggatgaagaaggaagttgctattaaaaaaaagtagggtacattatataaaatgttgttagaaaaactagctaaccccatccatagaagatgctggtgagcaattaaaatttaggtaataatagaaagatttttttactatgatttttaaaattttacttgaatgaaggctgctccggtccttattatcggattttttttcatgtgttggtttttataagtgtcacagacatgaagcaagattttcttctccagcaagctcttatgaaatagcttgtattaaaatatgatctaaacatcgtgctctctatctctaatgacgaaaactgtttgagttaaaaatgtctgtttttgtaaaacaaatgtgttctatatttttgtagattttagattttctactgattggatactccaaatttatcaagttctgcaccacacagaaggagattttgagtgtcaataatgaaacacttaactcattaaaaaaatgatttaagaagactagttaaaggtttattcttgaatctgctagcatggtgtaaagttgagccttttaacatacttcctttgagtgacatgaaattggtgctgttgcttgtggtggtagagaagtatgaaagtattaacttcttctaaaacaaaatcattcagacttaaaaaaaaaaaaaaggtcaatatttccttgcaggctgggagcacagattaaaccccagggccttaaaaacttcagctctgcctacagcagtttacaaaaatactaaactgcaatcaatgtaaataaaattcttagtgctatcctgagaccagaaagaatctcaggctaataaggaatccggtttgcatatgctgtcaaaagggtgtcatctaaccgaggtttcagtgtaaatgaggtcgctgtgcaacttggacccatctggcatagagcaagctgctttcttgtttttctagtatagttctcactgccttacttaaatcgagttgataaacttaatgcaactgtttctatgatcctagagaaaggactgaaatgttattgaaaactttccgactgtagtaagctttaggattttgactgcactactgtgtttggtgactgtgccagtcccttgctttctgtgtttgctctgcctttggtatcttagcaaagaaaaataaaaaaagaaaaaaaaaacataaaaaaaaaagaaaaaagaaaaaaaagaggaaaaaaaagtgggggaaaaaatgagagccacattccatttctagcactttgggagctctttcagtatttttttgtgtcttttcagcatcctcagatgcgacaggcaataattctgtttgtgacactgggaacatcccctcttctttgtggtgtgtgttgattccattttgtccagtgctgctgtccttcctccccctctgacacaggccttctttccagaacatttgtaacttgtaatacaaacaagtgacagccacagtgatgcagcgtcagtttctgaatgtcatcaggttctcatatctaaacatgtcaagttttttccctgtaacttctgtagtctgtgatgctggtcataatactgtctacattcctacgcaaagaaaaaaaaatctatcttggaggaaatctgagatcaataggagtagaggattttgttgctatgcttgtaacaagtagaaaactttgtatttaaagtttattcttggtcattatttattattataatacatcagttgacagaactttattctggtatagaaagtattaaaagttgttttttca

SEQ ID NO: 202849 - DNA, 3099 bp, Homo sapiens
  Payload ID: 20007
  Gene Name: zinc finger protein 540
  Uniprot ID: Q8NDQ6
  ENST ID: ENST00000316433
  CDS Start-End: 283-2265
gggtccggcgctccagaacagaacgatccctgaggctcccttgctcgaactgtgggacttaccctactatggtccgagcctaccctatttcattatactcaagtaacgccccagaaattccagagaatctcacacaaagaggttgagtcttgccgtggtgccttcaggggaatgtcatcccgggctagaagagctgcaaaaggctgtcaggcttctcagaactttgcttctccagcagaataatcctgcggaagactgagcagttcttgtgagtgtaaaaccatggcccatgcattggtgacgttcagggatgtggctatagacttctctcagaaggaatgggagtgcctggacactacccagaggaaattgtacagagatgtgatgttggagaattataataacttggtctcactgggatattctggctcaaagccagatgtgattaccttactggagcaagggaaagagccctgcgtggtggcgagggatgtgacaggaagacagtgccccggtttgttatccaggcataagaccaagaaattatcttcagaaaaggacattcatgaaatcagtttatccaaagagagtataatagaaaaaagtaaaactcttcgtctgaaaggatccatttttagaaatgagtggcagaacaaaagtgagtttgagggtcaacagggacttaaagaaagatctatcagtcaaaagaaaatcgtctctaaaaaaatgtcaactgatagaaaacgtccctcttttactctgaatcagagaattcacaatagtgagaaaagctgtgactcacacttggttcaacatgggaaaatagattctgatgtgaaacatgattgtaaagaatgtgggagtacttttaataatgtctatcagcttactctccatcagaaaattcatactggtgaaaaatcctgtaaatgtgagaaatgtgggaaagtttttagtcatagctatcaacttactctgcatcagagatttcatactggtgagaaaccctatgaatgtcaagaatgtgggaagacctttactctttacccacaacttaatcgacatcagaaaattcacactggtaaaaaaccctatatgtgtaagaaatgtgataagggtttttttagtagattagaacttactcaacataaaagaattcatactggtaagaaatcttatgaatgtaaagaatgtggaaaagtttttcaacttattttctactttaaagaacatgagagaattcatacaggtaagaaaccctatgaatgtaaggagtgtgggaaagcttttagtgtatgcggacaacttacccgtcatcagaaaattcatactggtgtaaaaccctacgaatgtaaggaatgtggaaagacctttagacttagtttttaccttactgaacacagaagaactcatgcaggtaagaaaccttatgaatgtaaggagtgtgggaaatcatttaatgtgcgtggacagcttaatcggcataaaacaatccatactggtataaaaccttttgcatgtaaggtgtgtgagaaggcttttagttatagtggtgacctcagagtacattctagaattcatactggagagaaaccatatgaatgtaaggaatgcgggaaagcctttatgcttcgttcagtccttactgaacatcagagacttcatactggtgtgaagccctacgaatgtaaggaatgtgggaagacctttcgagttcgttctcaaattagtctacataagaaaattcatactgatgtgaagccctacaaatgtgtacgatgtgggaagacctttagatttggtttctaccttactgaacaccagagaattcacactggtgaaaagccctataaatgtaaagaatgtggaaaggcctttattcgtagagggaatcttaaagaacatctgaaaattcattctggtttaaaaccctatgactgtaaagaatgtgggaagtcctttagtcggcgtgggcagttcactgaacatcagaaaattcatacgggtgtaaaaccatacaaatgtaaagaatgtgggaaggcctttagtcgtagtgtagaccttagaatacatcaaagaattcatactggtgagaaaccctatgagtgtaaacaatgtgggaaggcctttagacttaattcacaccttactgaacatcagagaattcacactggtgagaaaccctatgagtgtaaggtatgtagaaaggcctttagacaatattcacatctttatcaacatcagaaaactcataatgtaatttaatataagaaaaggtttccatgtcatgctctatttatagaatatcaaaatatttatggccagaagttctgtcaatgtgttgatgtttttttacacatattaacttaataaatgtatgagtcttaaatacctcttagttctcattaaatttaggaaaattcacactagaaaataaagctgttaatgtaacagttgtggaaaagtgttctagcaacagcatatacttatcatcattgcctttccactactctactatctgtgtgatattagacaaaatatttgcttcttggtacctcagctgtaaaatgaaacacacctaaaagtgtggttgtttccaacatgtataatacagcaacaactatctggcccaaactgctttggattaatattggatattactgtttttattatcatcaacattattattagtggatttcttaataggaagatgcaatggagatgacaaatttggaaaaaccactcatcacttacatttcatgaagtacttctttgataaaatctgttatgggctgaatgtttgtgttcccgtaacaattcctatgttgaaacacgaatcccaaggtgatggtatttgaaggtagggcctttaggaggaaattaggtcatgagggtggagccttcatgagtggaattactgcctttataagaagaagccaaagagccagctagctctttcaaccacatgaggttacagcaagaagtcagcagtctacagtgcaaaagagggccttcaccagaacccaagcatgctggcaccttgaccttggactttcagcctccaaaactgtgagaaataaacctcagttgtttataagc

SEQ ID NO: 202850 - DNA, 3073 bp, Homo sapiens
  Payload ID: 20007
  Gene Name: zinc finger protein 540
  Uniprot ID: Q8NDQ6
  ENST ID: ENST00000343599
  CDS Start-End: 259-2241
tcctctgtgggtgcagagtgggtagtggccatgcctgtgtgatgtgcgtcagattatgcttgaggctattagtggcgcatttagtattgtgtgcggaagggtcttgggaatggtttgattatagctttgagggtgactgatgtctgtttaatcagattcagcctgcgactgagtatcttataacctgcttctcagaactttgcttctccagcagaataatcctgcggaagactgagcagttcttgtgagtgtaaaaccatggcccatgcattggtgacgttcagggatgtggctatagacttctctcagaaggaatgggagtgcctggacactacccagaggaaattgtacagagatgtgatgttggagaattataataacttggtctcactgggatattctggctcaaagccagatgtgattaccttactggagcaagggaaagagccctgcgtggtggcgagggatgtgacaggaagacagtgccccggtttgttatccaggcataagaccaagaaattatcttcagaaaaggacattcatgaaatcagtttatccaaagagagtataatagaaaaaagtaaaactcttcgtctgaaaggatccatttttagaaatgagtggcagaacaaaagtgagtttgagggtcaacagggacttaaagaaagatctatcagtcaaaagaaaatcgtctctaaaaaaatgtcaactgatagaaaacgtccctcttttactctgaatcagagaattcacaatagtgagaaaagctgtgactcacacttggttcaacatgggaaaatagattctgatgtgaaacatgattgtaaagaatgtgggagtacttttaataatgtctatcagcttactctccatcagaaaattcatactggtgaaaaatcctgtaaatgtgagaaatgtgggaaagtttttagtcatagctatcaacttactctgcatcagagatttcatactggtgagaaaccctatgaatgtcaagaatgtgggaagacctttactctttacccacaacttaatcgacatcagaaaattcacactggtaaaaaaccctatatgtgtaagaaatgtgataagggtttttttagtagattagaacttactcaacataaaagaattcatactggtaagaaatcttatgaatgtaaagaatgtggaaaagtttttcaacttattttctactttaaagaacatgagagaattcatacaggtaagaaaccctatgaatgtaaggagtgtgggaaagcttttagtgtatgcggacaacttacccgtcatcagaaaattcatactggtgtaaaaccctacgaatgtaaggaatgtggaaagacctttagacttagtttttaccttactgaacacagaagaactcatgcaggtaagaaaccttatgaatgtaaggagtgtgggaaatcatttaatgtgcgtggacagcttaatcggcataaaacaatccatactggtataaaaccttttgcatgtaaggtgtgtgagaaggcttttagttatagtggtgacctcagagtacattctagaattcatactggagagaaaccatatgaatgtaaggaatgcgggaaagcctttatgcttcgttcagtccttactgaacatcagagacttcatactggtgtgaagccctacgaatgtaaggaatgtgggaagacctttcgagttcgttctcaaattagtctacataagaaaattcatactgatgtgaagccctacaaatgtgtacgatgtgggaagacctttagatttggtttctaccttactgaacaccagagaattcacactggtgaaaagccctataaatgtaaagaatgtggaaaggcctttattcgtagagggaatcttaaagaacatctgaaaattcattctggtttaaaaccctatgactgtaaagaatgtgggaagtcctttagtcggcgtgggcagttcactgaacatcagaaaattcatacgggtgtaaaaccatacaaatgtaaagaatgtgggaaggcctttagtcgtagtgtagaccttagaatacatcaaagaattcatactggtgagaaaccctatgagtgtaaacaatgtgggaaggcctttagacttaattcacaccttactgaacatcagagaattcacactggtgagaaaccctatgagtgtaaggtatgtagaaaggcctttagacaatattcacatctttatcaacatcagaaaactcataatgtaatttaatataagaaaaggtttccatgtcatgctctatttatagaatatcaaaatatttatggccagaagttctgtcaatgtgttgatgtttttttacacatattaacttaataaatgtatgagtcttaaatacctcttagttctcattaaatttaggaaaattcacactagaaaataaagctgttaatgtaacagttgtggaaaagtgttctagcaacagcatatacttatcatcattgcctttccactactctactatctgtgtgatattagacaaaatatttgcttcttggtacctcagctgtaaaatgaaacacacctaaaagtgtggttgtttccaacatgtataatacagcaacaactatctggcccaaactgctttggattaatattggatattactgtttttattatcatcaacattattattagtggatttcttaataggaagatgcaatggagatgacaaatttggaaaaaccactcatcacttacatttcatgaagtacttctttgataaaatctgttatgggctgaatgtttgtgttcccgtaacaattcctatgttgaaacacgaatcccaaggtgatggtatttgaaggtagggcctttaggaggaaattaggtcatgagggtggagccttcatgagtggaattactgcctttataagaagaagccaaagagccagctagctctttcaaccacatgaggttacagcaagaagtcagcagtctacagtgcaaaagagggccttcaccagaacccaagcatgctggcaccttgaccttggactttcagcctccaaaactgtgagaaataaacctcagttgtttataa

SEQ ID NO: 202851 - DNA, 2038 bp, Homo sapiens
  Payload ID: 20007
  Gene Name: zinc finger protein 540
  ENST ID: ENST00000586134
  CDS Start-End: 383-2038
cgatccctgaggctcccttgctcgaactgtgggacttaccctactatggtccgagcctaccctatttcattatactcaagtaacgccccagaaattccagagaatctcacacaaagaggttgagtcttgccgtggtgccttcaggggaatgtcatcccgggctagaagagctgcaaaaggctgtcagacggagtttcaatcttgttacgcaggctggagtgcaatggggcgatctcagctcaccgcagcctccccctcccagattcaagcgattttcctgcctcagtctcctgagtagctgggattataggcttctcagaactttgcttctccagcagaataatcctgcggaagactgagcagttcttgtgagtgtaaaaccatggcccatgcattggtgacgttcagggatgtggctatagacttctctcagaaggaatgggagtgcctggacactacccagaggaaattgtacagagatgtgatgttggagaattataataacttggtctcactgggatattctggctcaaagccagatgtgattaccttactggagcaagggaaagagccctgcgtggtggcgagggatgtgacaggaagacagtgccccggtttgttatccaggcataagaccaagaaattatcttcagaaaaggacattcatgaaatcagtttatccaaagagagtataatagaaaaaagtaaaactcttcgtctgaaaggatccatttttagaaatgagtggcagaacaaaagtgagtttgagggtcaacagggacttaaagaaagatctatcagtcaaaagaaaatcgtctctaaaaaaatgtcaactgatagaaaacgtccctcttttactctgaatcagagaattcacaatagtgagaaaagctgtgactcacacttggttcaacatgggaaaatagattctgatgtgaaacatgattgtaaagaatgtgggagtacttttaataatgtctatcagcttactctccatcagaaaattcatactggtgaaaaatcctgtaaatgtgagaaatgtgggaaagtttttagtcatagctatcaacttactctgcatcagagatttcatactggtgagaaaccctatgaatgtcaagaatgtgggaagacctttactctttacccacaacttaatcgacatcagaaaattcacactggtaaaaaaccctatatgtgtaagaaatgtgataagggtttttttagtagattagaacttactcaacataaaagaattcatactggtaagaaatcttatgaatgtaaagaatgtggaaaagtttttcaacttattttctactttaaagaacatgagagaattcatacaggtaagaaaccctatgaatgtaaggagtgtgggaaagcttttagtgtatgcggacaacttacccgtcatcagaaaattcatactggtgtaaaaccctacgaatgtaaggaatgtggaaagacctttagacttagtttttaccttactgaacacagaagaactcatgcaggtaagaaaccttatgaatgtaaggagtgtgggaaatcatttaatgtgcgtggacagcttaatcggcataaaacaatccatactggtataaaaccttttgcatgtaaggtgtgtgagaaggcttttagttatagtggtgacctcagagtacattctagaattcatactggagagaaaccatatgaatgtaaggaatgcgggaaagcctttatgcttcgttcagtccttactgaacatcagagacttcatactggtgtgaagccctacgaatgtaaggaatgtgggaagacctttcgagttcgttctcaaattagtctacataagaaaattcatactgatgtgaagccctacaaatgtgtacgatgtgggaagacctttagatttggtttctaccttactgaacaccagagaattcacactggtgaaaagccctataaatgtaaagaatgtggaaaggcctttattcgtagagggaatcttaaagaacatctgaaaattcattctggtttaaaaccctatgac

SEQ ID NO: 202852 - DNA, 3147 bp, Homo sapiens
  Payload ID: 20007
  Gene Name: zinc finger protein 540
  Uniprot ID: Q8NDQ6
  ENST ID: ENST00000592533
  CDS Start-End: 333-2315
ggccctagcggcttggcggagctggagccctccctggcagtgcgtcggcgctgggctatggccccctcctctccgggggatcgtcgccttggtcccccgaccctaggagtcgggcagggcagaaccaggctaaagaaacgtccagcgtagcttcaaggatgcaccgcgtgatccctatcggatctccccgacgcgtcaggcctgcctagacggtgctgggagcgcgtctccttgaacgttgtcccgcctgggattgcgaggcttctcagaactttgcttctccagcagaataatcctgcggaagactgagcagttcttgtgagtgtaaaaccatggcccatgcattggtgacgttcagggatgtggctatagacttctctcagaaggaatgggagtgcctggacactacccagaggaaattgtacagagatgtgatgttggagaattataataacttggtctcactgggatattctggctcaaagccagatgtgattaccttactggagcaagggaaagagccctgcgtggtggcgagggatgtgacaggaagacagtgccccggtttgttatccaggcataagaccaagaaattatcttcagaaaaggacattcatgaaatcagtttatccaaagagagtataatagaaaaaagtaaaactcttcgtctgaaaggatccatttttagaaatgagtggcagaacaaaagtgagtttgagggtcaacagggacttaaagaaagatctatcagtcaaaagaaaatcgtctctaaaaaaatgtcaactgatagaaaacgtccctcttttactctgaatcagagaattcacaatagtgagaaaagctgtgactcacacttggttcaacatgggaaaatagattctgatgtgaaacatgattgtaaagaatgtgggagtacttttaataatgtctatcagcttactctccatcagaaaattcatactggtgaaaaatcctgtaaatgtgagaaatgtgggaaagtttttagtcatagctatcaacttactctgcatcagagatttcatactggtgagaaaccctatgaatgtcaagaatgtgggaagacctttactctttacccacaacttaatcgacatcagaaaattcacactggtaaaaaaccctatatgtgtaagaaatgtgataagggtttttttagtagattagaacttactcaacataaaagaattcatactggtaagaaatcttatgaatgtaaagaatgtggaaaagtttttcaacttattttctactttaaagaacatgagagaattcatacaggtaagaaaccctatgaatgtaaggagtgtgggaaagcttttagtgtatgcggacaacttacccgtcatcagaaaattcatactggtgtaaaaccctacgaatgtaaggaatgtggaaagacctttagacttagtttttaccttactgaacacagaagaactcatgcaggtaagaaaccttatgaatgtaaggagtgtgggaaatcatttaatgtgcgtggacagcttaatcggcataaaacaatccatactggtataaaaccttttgcatgtaaggtgtgtgagaaggcttttagttatagtggtgacctcagagtacattctagaattcatactggagagaaaccatatgaatgtaaggaatgcgggaaagcctttatgcttcgttcagtccttactgaacatcagagacttcatactggtgtgaagccctacgaatgtaaggaatgtgggaagacctttcgagttcgttctcaaattagtctacataagaaaattcatactgatgtgaagccctacaaatgtgtacgatgtgggaagacctttagatttggtttctaccttactgaacaccagagaattcacactggtgaaaagccctataaatgtaaagaatgtggaaaggcctttattcgtagagggaatcttaaagaacatctgaaaattcattctggtttaaaaccctatgactgtaaagaatgtgggaagtcctttagtcggcgtgggcagttcactgaacatcagaaaattcatacgggtgtaaaaccatacaaatgtaaagaatgtgggaaggcctttagtcgtagtgtagaccttagaatacatcaaagaattcatactggtgagaaaccctatgagtgtaaacaatgtgggaaggcctttagacttaattcacaccttactgaacatcagagaattcacactggtgagaaaccctatgagtgtaaggtatgtagaaaggcctttagacaatattcacatctttatcaacatcagaaaactcataatgtaatttaatataagaaaaggtttccatgtcatgctctatttatagaatatcaaaatatttatggccagaagttctgtcaatgtgttgatgtttttttacacatattaacttaataaatgtatgagtcttaaatacctcttagttctcattaaatttaggaaaattcacactagaaaataaagctgttaatgtaacagttgtggaaaagtgttctagcaacagcatatacttatcatcattgcctttccactactctactatctgtgtgatattagacaaaatatttgcttcttggtacctcagctgtaaaatgaaacacacctaaaagtgtggttgtttccaacatgtataatacagcaacaactatctggcccaaactgctttggattaatattggatattactgtttttattatcatcaacattattattagtggatttcttaataggaagatgcaatggagatgacaaatttggaaaaaccactcatcacttacatttcatgaagtacttctttgataaaatctgttatgggctgaatgtttgtgttcccgtaacaattcctatgttgaaacacgaatcccaaggtgatggtatttgaaggtagggcctttaggaggaaattaggtcatgagggtggagccttcatgagtggaattactgcctttataagaagaagccaaagagccagctagctctttcaaccacatgaggttacagcaagaagtcagcagtctacagtgcaaaagagggccttcaccagaacccaagcatgctggcaccttgaccttggactttcagcctccaaaactgtgagaaataaacctcagttgtttataa

SEQ ID NO: 202853 - DNA, 2349 bp, Homo sapiens
  Payload ID: 20007
  Gene Name: zinc finger protein 540
  Uniprot ID: Q8NDQ6
  ENST ID: ENST00000589117
  CDS Start-End: 339-2225
agtctacaactggaaaccggccggatcgtgtctgcgcaggcccagcagctaagatcgggtccggcgctccagaacagaacgatccctgaggctcccttgctcgaactgtgggacttaccctactatggtccgagcctaccctatttcattatactcaagtaacgccccagaaattccagagaatctcacacaaagaggttgagtcttgccgtggtgccttcaggggaatgtcatcccgggctagaagagctgcaaaaggctgtcaggcttctcagaactttgcttctccagcagaataatcctgcggaagactgagcagttcttgtgagtgtaaaaccatggcccatgcattggtgacgttcagggatgtggctatagacttctctcagaaggaatgggagtgcctggacactacccagaggaaattgtacagagatgtgatgttggagaattataataacttggtctcactgggtttgttatccaggcataagaccaagaaattatcttcagaaaaggacattcatgaaatcagtttatccaaagagagtataatagaaaaaagtaaaactcttcgtctgaaaggatccatttttagaaatgagtggcagaacaaaagtgagtttgagggtcaacagggacttaaagaaagatctatcagtcaaaagaaaatcgtctctaaaaaaatgtcaactgatagaaaacgtccctcttttactctgaatcagagaattcacaatagtgagaaaagctgtgactcacacttggttcaacatgggaaaatagattctgatgtgaaacatgattgtaaagaatgtgggagtacttttaataatgtctatcagcttactctccatcagaaaattcatactggtgaaaaatcctgtaaatgtgagaaatgtgggaaagtttttagtcatagctatcaacttactctgcatcagagatttcatactggtgagaaaccctatgaatgtcaagaatgtgggaagacctttactctttacccacaacttaatcgacatcagaaaattcacactggtaaaaaaccctatatgtgtaagaaatgtgataagggtttttttagtagattagaacttactcaacataaaagaattcatactggtaagaaatcttatgaatgtaaagaatgtggaaaagtttttcaacttattttctactttaaagaacatgagagaattcatacaggtaagaaaccctatgaatgtaaggagtgtgggaaagcttttagtgtatgcggacaacttacccgtcatcagaaaattcatactggtgtaaaaccctacgaatgtaaggaatgtggaaagacctttagacttagtttttaccttactgaacacagaagaactcatgcaggtaagaaaccttatgaatgtaaggagtgtgggaaatcatttaatgtgcgtggacagcttaatcggcataaaacaatccatactggtataaaaccttttgcatgtaaggtgtgtgagaaggcttttagttatagtggtgacctcagagtacattctagaattcatactggagagaaaccatatgaatgtaaggaatgcgggaaagcctttatgcttcgttcagtccttactgaacatcagagacttcatactggtgtgaagccctacgaatgtaaggaatgtgggaagacctttcgagttcgttctcaaattagtctacataagaaaattcatactgatgtgaagccctacaaatgtgtacgatgtgggaagacctttagatttggtttctaccttactgaacaccagagaattcacactggtgaaaagccctataaatgtaaagaatgtggaaaggcctttattcgtagagggaatcttaaagaacatctgaaaattcattctggtttaaaaccctatgactgtaaagaatgtgggaagtcctttagtcggcgtgggcagttcactgaacatcagaaaattcatacgggtgtaaaaccatacaaatgtaaagaatgtgggaaggcctttagtcgtagtgtagaccttagaatacatcaaagaattcatactggtgagaaaccctatgagtgtaaacaatgtgggaaggcctttagacttaattcacaccttactgaacatcagagaattcacactggtgagaaaccctatgagtgtaaggtatgtagaaaggcctttagacaatattcacatctttatcaacatcagaaaactcataatgtaatttaatataagaaaaggtttccatgtcatgctctatttatagaatatcaaaatatttatggccagaagttctgtcaatgtgttgatgtttttttacacatattaacttaataaatgtatgagtcttaaa

SEQ ID NO: 202854 - DNA, 563 bp, Homo sapiens
  Payload ID: 20007
  Gene Name: zinc finger protein 540
  ENST ID: ENST00000590588
  CDS Start-End: 264-563
agaacgatccctgaggctcccttgctcgaactgtgggacttaccctactatggtccgagcctaccctatttcattatactcaagtaacgccccagaaattccagagaatctcacacaaagaggttgagtcttgccgtggtgccttcaggggaatgtcatcccgggctagaagagctgcaaaaggctgtcaggcttctcagaactttgcttctccagcagaataatcctgcggaagactgagcagttcttgtgagtgtaaaaccatggcccatgcattggtgacgttcagggatgtggctatagacttctctcagaaggaatgggagtgcctggacactacccagaggaaattgtacagagatgtgatgttggagaattataataacttggtctcactggcaggatattctggctcaaagccagatgtgattaccttactggagcaagggaaagagccctgcgtggtggcgagggatgtgacaggaagacagtgccccggtttgttatccaggcataagaccaagaaattatcttcagaaaaggacattcatgaaatcagttta

SEQ ID NO: 202855 - DNA, 564 bp, Homo sapiens
  Payload ID: 20007
  Gene Name: zinc finger protein 540
  ENST ID: ENST00000586792
  CDS Start-End: 196-285
tttcattatactcaagtaacgccccagaaattccagagaatctcacacaaagaggttgagtcttgccgtggtgccttcaggggaatgtcatcccgggctagaagagctgcaaaaggctgtcaggcttctcagaactttgcttctccagcagaataatcctgcggaagactgagcagttcttgtgagtgtaaaaccatggcccatgtttgttatccaggcataagaccaagaaattatcttcagaaaaggacattcatgaaatcagtttatccaaagagagtataatagaaaaaagtaaaactcttcgtctgaaaggatccatttttagaaatgagtggcagaacaaaagtgagtttgagggtcaacagggacttaaagaaagatctatcagtcaaaagaaaatcgtctctaaaaaaatgtcaactgatagaaaacgtccctcttttactctgaatcagagaattcacaatagtgagaaaagctgtgactcacacttggttcaacatgggaaaatagattctgatgtgaaacatgattgtaaagaatgtgggagtacttttaata

SEQ ID NO: 202856 - DNA, 2573 bp, Homo sapiens
  Payload ID: 20008
  Gene Name: zinc finger protein 541
  ENST ID: ENST00000263351
  CDS Start-End: 1-2039
gccacagcttccagtggctccggaacctgccgggctgtcccaaaagcaaaggcaacaacgtgtttgttgtccacaagccctcggccgtgccctcgcgggagggctccgagtctggcccgggacccagcagcggaagcccctcggaggagtccccgcccggccccggcggtggcctggaggatgctctgcccttccctgccgcgctcctcagggtccccgcggaggccccgagcgaccccaggtcggccagcggggaagatgacccctgcgcccccaagaaggtcaaggtcgactgcgactccttcctgtgccagaaccccggggagcccggcctccaggaggcccagaaggcaggcgggctccctgcggatgcctcgccgctcttccgccagctcttcctcaagtcgcaggaacctcttgtgagccacgagcagatgcaggtgttccagatgatcaccaagtcccagcggatcttctcccatgcccaggtggcagcagtctcctcccagctccctgcgcccgagggcaaaccagccgccctgaggccgctgcaggggccgtggccgcagcagcccccaccactggctcctgctgtggactctctccacgccggccctggaaaccccgaggcagagggctccccagcccgcaggagaaaaaccacacccggggttcccagagaggcctcccccggcagcacgagacgagacgcaaaggggggactgaaagtggccgcggttccaacgccccttgcagcaccgtctctggacccttccaggaatccagacatctcttctctggccaagcagctgcgatcctctaaagggaccttggacctggaggacatcttcccctccacaggccaacggcagacccagttaggtggggaggagccaccaggagcctcgctgccagggaagcaggccccagccgagaatggcgcggcttcaaggatcacaaaaggtgaaaagggcccagcctgctcccggggtggaggctaccggctcttgggcaaccccagggccccgcgattctccggcttccggaaagagaaggcgaagatggatatgtgctgtgcggcttctccgagccaggtagccatggcctccttctcatcggccgggcccccggcagatccctccaagtccaagctgacaatattcagcagaatccagggtggaaacatctacaggctcccccatccggtgaaggaagagaatgtggcaggcagaggtaaccagcaaaacggcagtcccacagactggacgaagcccaggagcacttttgtctgcaagaactgcagccagatgttttatacggagaaagggctgagcagccacatgtgttttcacagcgaccagtggccgtcacctcgagggaagcaggaaccgcaggtgtttggcacagagttttgcaagccgctaagacaggtgctgaggccagaaggggacaggcatagtcccccaggaaccaagaagcccttggaccccacagctgcagcccctttggtggtcccccaatcgatccccgtggttccagtgacccgacacatagggagcatggccatgatccagacaaagacggtagctcagtgcgttgagtattattacatctggaaaaaaatgatcaagtttgactgtggccgagccccagggctagaaaagagggtcaagagagagccggaggaagtggaaaggacagaggaaaaggtcccatgcagccctcgggagagacccagccaccatccaactcccaagttaaagaccaagagttataggagggagtccatcctcagctccagcccaaatgcaggctccaagcggacccccgagctgttgggaagtgcagagagccagggcatttttccatgcagagagtgtgaaagggtgtttgacaagatcaagagtcgaaatgcccatatgaagcggcaccgccttcaggaccacgtggagcccatcatcagggtgaagtggccagtgaagcccttccagctaaaggaagaggagctgggagctgacatcggccccctgcagtggtgactcccgtggcagcaagtccgaatggggcctccagtgctgcccctcctcccttcggcctctccagggcgtttggggcacccctctgcctccccccaccctccctgtcccctgttggccaacctgcctgcaaacatggagggcatttggccacagataggcaggaggagctcagttgtcggacagctatgcagtccctgtccggtggtgctggaggctccactctccttaggttcatagtctctccccttctttcccttccacttctagagcagggaggcttggggaggggaaaatttagctctgggtagctcttaaatcttagcctcagttgtggggtttggtttcatgtgttagataaggccaagacttagagaatcagtgggaaaaaaccttgagatctccaacacgctgggcccctccctggggcggggactctaccttccagattcagtccctagtcttgcgatgaattctgcattgttcggtgttttttgtacatgtcaactcgtaaatctgattaaattgggttcttga

SEQ ID NO: 202857 - DNA, 4631 bp, Homo sapiens
  Payload ID: 20008
  Gene Name: zinc finger protein 541
  ENST ID: ENST00000314121
  CDS Start-End: 1-4098
atggaccagtacagccttggagacgagggtgccctcccatcagaaatgcacctcccttcattttcagagagccaagggctcaactgcagcgacaccctcaaccgggatttgggtcccaacacgcgaggctttctttatgctggcctgagtggtctggacccggaccccagcctcccaacgcctgacatgtccagcgaggtgctggaggacaacttagacaccttgtccctgtactccgggaaggacagtgattctgtgaagctgctggaggagtacgcagattcggagtctcaggcatccttacaagacctggggctaggtgtgcttaaggctaaagaggctgacgaaggaggaagggccacctcggggagtgccaggaaaggaaagcggcagcacagttcccctcaaaacccacttctggactgcagcctgtgcgggaaggtgttcagcagcgccagttctctgagcaagcactacctgacacacagccaggaaaggaagcacgtctgcaaaatctgcagcaaggcctttaagcgccaggaccacctgaccgggcacatgctcacccaccagaagacaaagcccttcgtgtgcatcgagcagggctgcagcaagagctactgcgactaccgctctctgcgccggcactacgaggtccatcacggcctgtgcatcctgaaggaagcccccccggaggaagaggcctgcggggactccccccacgcccacgagtcggccggccagccgccccccagcagcctgcggtccctggtgcccccagaggccaggtcccccggctccctcctgccccaccgggacctcctgcgccgcatcgtgagtagcatcgtccaccagaagaccccttctcctggcccagccccggcgggggcttcagacagcgaagggaggaacactgcctgtccctgccccgcctcatcggggtcctcgtcctgcaccccagccggcccccacgcggccccagcagcgctggacaccgagcttcccgaggagccttgcctcccacagaaagagccggccactgacgtgttcacagcccctaattccagggccgccgagaacggcgcccccgacccgccagagccggagccagataccgcgctgctccaggcccggtccaccgcggagtgctggcccgaaggcggctccgtgcctgcctgcctgcctctcttccgaggccagacggtccctgccagttcccagccatcgagccacagcttccagtggctccggaacctgccgggctgtcccaaaagcaaaggcaacaacgtgtttgttgtccacaagccctcggccgtgccctcgcgggagggctccgagtctggcccgggacccagcagcggaagcccctcggaggagtccccgcccggccccggcggtggcctggaggatgctctgcccttccctgccgcgctcctcagggtccccgcggaggccccgagcgaccccaggtcggccagcggggaagatgacccctgcgcccccaagaaggtcaaggtcgactgcgactccttcctgtgccagaaccccggggagcccggcctccaggaggcccagaaggcaggcgggctccctgcggatgcctcgccgctcttccgccagctcttcctcaagtcgcaggaacctcttgtgagccacgagcagatgcaggtgttccagatgatcaccaagtcccagcggatcttctcccatgcccaggtggcagcagtctcctcccagctccctgcgcccgagggcaaaccagccgccctgaggccgctgcaggggccgtggccgcagcagcccccaccactggctcctgctgtggactctctccacgccggccctggaaaccccgaggcagagggctccccagcccgcaggagaaaaaccacacccggggttcccagagaggcctcccccggcagcacgagacgagacgcaaaggggggactgaaagtggccgcggttccaacgccccttgcagcaccgtctctggacccttccaggaatccagacatctcttctctggccaagcagctgcgatcctctaaagggaccttggacctggaggacatcttcccctccacaggccaacggcagacccagttaggtggggaggagccaccaggagcctcgctgccagggaagcaggccccagccgagaatggcgcggcttcaaggatcacaaaaggtgaaaagggcccagcctgctcccggggtggaggctaccggctcttgggcaaccccagggccccgcgattctccggcttccggaaagagaaggcgaagatggatatgtgctgtgcggcttctccgagccaggtagccatggcctccttctcatcggccgggcccccggcagatccctccaagtccaagctgacaatattcagcagaatccagggtggaaacatctacaggctcccccatccggtgaaggaagagaatgtggcaggcagaggtaaccagcaaaacggcagtcccacagactggacgaagcccaggagcacttttgtctgcaagaactgcagccagatgttttatacggagaaagggctgagcagccacatgtgttttcacagcgaccagtggccgtcacctcgagggaagcaggaaccgcaggtgtttggcacagagttttgcaagccgctaagacaggtgctgaggccagaaggggacaggcatagtcccccaggaaccaagaagcccttggaccccacagctgcagcccctttggtggtcccccaatcgatccccgtggttccagtgacccgacacatagggagcatggccatgatggagtggtgcagtaggtggcttcaggcgaccacctgtggttctaaacttcttcagggacaagagaaagacggggaggagcgagacagcaaggagagcagccagcagagaaagcggaagaagcggcccccaccctccacggctggggagcctggccctgcaggatgccaccagagccgcctgcggtcacccatgttcctggtggactgcctcctgaagggcttattccagtgctccccctacacaccacccccaatgctcagccccatccgggagggctctggggtgtacttcaacaccctctgttccacgtccactcaggccagccctgaccagctcatcagctccatgctcgatcaagtggatgggtcctttggcatctgtgtggtgaaggatgacaccaaaatcagcattgagccacatatcaatataggaagccggtttcaggcagagatcccggaactccaggagagatccctggctggaactgacgagcatgtagcttctctggtctggaagccatggggagatatgatgatcagctcagagacacaggatagagtgaccgagctctgcaatgtggcatgctccagcgtgatgccaggagggggcaccaacctggagctcgctctgcactgcctgcacgaggctcagggcaacgttcaggtcgccctggagactcttctgctccgagggccccacaagccacggacacacctgctcgctgactatcgctacacaggttcagacgtctggacccctatagagaagaggctttttaagaaggcgttctatgcccacaagaaggacttctacttgatacacaagatgatccagacaaagacggtagctcagtgcgttgagtattattacatctggaaaaaaatgatcaagtttgactgtggccgagccccagggctagaaaagagggtcaagagagagccggaggaagtggaaaggacagaggaaaaggtcccatgcagccctcgggagagacccagccaccatccaactcccaagttaaagaccaagagttataggagggagtccatcctcagctccagcccaaatgcaggctccaagcggacccccgagctgttgggaagtgcagagagccagggcatttttccatgcagagagtgtgaaagggtgtttgacaagatcaagagtcgaaatgcccatatgaagcggcaccgccttcaggaccacgtggagcccatcatcagggtgaagtggccagtgaagcccttccagctaaaggaagaggagctgggagctgacatcggccccctgcagtggtgactcccgtggcagcaagtccgaatggggcctccagtgctgcccctcctcccttcggcctctccagggcgtttggggcacccctctgcctccccccaccctccctgtcccctgttggccaacctgcctgcaaacatggagggcatttggccacagataggcaggaggagctcagttgtcggacagctatgcagtccctgtccggtggtgctggaggctccactctccttaggttcatagtctctccccttctttcccttccacttctagagcagggaggcttggggaggggaaaatttagctctgggtagctcttaaatcttagcctcagttgtggggtttggtttcatgtgttagataaggccaagacttagagaatcagtgggaaaaaaccttgagatctccaacacgctgggcccctccctggggcggggactctaccttccagattcagtccctagtcttgcgatgaattctgcattgttcggtgttttttgtacatgtcaactcgtaaatctgattaaattgggttcttg

SEQ ID NO: 202858 - DNA, 4580 bp, Homo sapiens
  Payload ID: 20008
  Gene Name: zinc finger protein 541
  Uniprot ID: Q9H0D2
  ENST ID: ENST00000391901
  CDS Start-End: 1-4041
atggaccagtacagccttggagacgagggtgccctcccatcagaaatgcacctcccttcattttcagagagccaagggctcaactgcagcgacaccctcaaccgggatttgggtcccaacacgcgaggctttctttatgctggcctgagtggtctggacccggaccccagcctcccaacgcctgacatgtccagcgaggtgctggaggacaacttagacaccttgtccctgtactccgggaaggacagtgattctgtgaagctgctggaggagtacgcagattcggagtctcaggcatccttacaagacctggggctaggtgtgcttaaggctaaagaggctgacgaaggaggaagggccacctcggggagtgccaggaaaggaaagcggcagcacagttcccctcaaaacccacttctggactgcagcctgtgcgggaaggtgttcagcagcgccagttctctgagcaagcactacctgacacacagccaggaaaggaagcacgtctgcaaaatctgcagcaaggcctttaagcgccaggaccacctgaccgggcacatgctcacccaccagaagacaaagcccttcgtgtgcatcgagcagggctgcagcaagagctactgcgactaccgctctctgcgccggcactacgaggtccatcacggcctgtgcatcctgaaggaagcccccccggaggaagaggcctgcggggactccccccacgcccacgagtcggccggccagccgccccccagcagcctgcggtccctggtgcccccagaggccaggtcccccggctccctcctgccccaccgggacctcctgcgccgcatcgtgagtagcatcgtccaccagaagaccccttctcctggcccagccccggcgggggcttcagacagcgaagggaggaacactgcctgtccctgccccgcctcatcggggtcctcgtcctgcaccccagccggcccccacgcggccccagcagcgctggacaccgagcttcccgaggagccttgcctcccacagaaagagccggccactgacgtgttcacagcccctaattccagggccgccgagaacggcgcccccgacccgccagagccggagccagataccgcgctgctccaggcccggtccaccgcggagtgctggcccgaaggcggctccgtgcctgcctgcctgcctctcttccgaggccagacggtccctgccagttcccagccatcgagccacagcttccagtggctccggaacctgccgggctgtcccaaaagcaaaggcaacaacgtgtttgttgtccacaagccctcggccgtgccctcgcgggagggctccgagtctggcccgggacccagcagcggaagcccctcggaggagtccccgcccggccccggcggtggcctggaggatgctctgcccttccctgccgcgctcctcagggtccccgcggaggccccgagcgaccccaggtcggccagcggggaagatgacccctgcgcccccaagaaggtcaaggtcgactgcgactccttcctgtgccagaaccccggggagcccggcctccaggaggcccagaaggcaggcgggctccctgcggatgcctcgccgctcttccgccagctcttcctcaagtcgcaggaacctcttgtgagccacgagcagatgcaggtgttccagatgatcaccaagtcccagcggatcttctcccatgcccaggtggcagcagtctcctcccagctccctgcgcccgagggcaaaccagccgccctgaggccgctgcaggggccgtggccgcagcagcccccaccactggctcctgctgtggactctctccacgccggccctggaaaccccgaggcagagggctccccagcccgcaggagaaaaaccacacccggggttcccagagaggcctcccccggcagcacgagacgagacgcaaaggggggactgaaagtggccgcggttccaacgccccttgcagcaccgtctctggacccttccaggaatccagacatctcttctctggccaagcagctgcgatcctctaaagggaccttggacctggaggacatcttcccctccacaggccaacggcagacccagttaggtggggaggagccaccaggagcctcgctgccagggaagcaggccccagccgagaatggcgcggcttcaaggatcacaaaaggtgaaaagggcccagcctgctcccggggtggaggctaccggctcttgggcaaccccagggccccgcgattctccggcttccggaaagagaaggcgaagatggatatgtgctgtgcggcttctccgagccaggtagccatggcctccttctcatcggccgggcccccggcagatccctccaagtccaagctgacaatattcagcagaatccagggtggaaacatctacaggctcccccatccggtgaaggaagagaatgtggcaggcagaggtaaccagcaaaacggcagtcccacagactggacgaagcccaggagcacttttgtctgcaagaactgcagccagatgttttatacggagaaagggctgagcagccacatgtgttttcacagcgaccagtggccgtcacctcgagggaagcaggaaccgcaggtgtttggcacagagttttgcaagccgctaagacaggtgctgaggccagaaggggacaggcatagtcccccaggaaccaagaagcccttggaccccacagctgcagcccctttggtggtcccccaatcgatccccgtggttccagtgacccgacacatagggagcatggccatgggacaagagaaagacggggaggagcgagacagcaaggagagcagccagcagagaaagcggaagaagcggcccccaccctccacggctggggagcctggccctgcaggatgccaccagagccgcctgcggtcacccatgttcctggtggactgcctcctgaagggcttattccagtgctccccctacacaccacccccaatgctcagccccatccgggagggctctggggtgtacttcaacaccctctgttccacgtccactcaggccagccctgaccagctcatcagctccatgctcgatcaagtggatgggtcctttggcatctgtgtggtgaaggatgacaccaaaatcagcattgagccacatatcaatataggaagccggtttcaggcagagatcccggaactccaggagagatccctggctggaactgacgagcatgtagcttctctggtctggaagccatggggagatatgatgatcagctcagagacacaggatagagtgaccgagctctgcaatgtggcatgctccagcgtgatgccaggagggggcaccaacctggagctcgctctgcactgcctgcacgaggctcagggcaacgttcaggtcgccctggagactcttctgctccgagggccccacaagccacggacacacctgctcgctgactatcgctacacaggttcagacgtctggacccctatagagaagaggctttttaagaaggcgttctatgcccacaagaaggacttctacttgatacacaagatgatccagacaaagacggtagctcagtgcgttgagtattattacatctggaaaaaaatgatcaagtttgactgtggccgagccccagggctagaaaagagggtcaagagagagccggaggaagtggaaaggacagaggaaaaggtcccatgcagccctcgggagagacccagccaccatccaactcccaagttaaagaccaagagttataggagggagtccatcctcagctccagcccaaatgcaggctccaagcggacccccgagctgttgggaagtgcagagagccagggcatttttccatgcagagagtgtgaaagggtgtttgacaagatcaagagtcgaaatgcccatatgaagcggcaccgccttcaggaccacgtggagcccatcatcagggtgaagtggccagtgaagcccttccagctaaaggaagaggagctgggagctgacatcggccccctgcagtggtgactcccgtggcagcaagtccgaatggggcctccagtgctgcccctcctcccttcggcctctccagggcgtttggggcacccctctgcctccccccaccctccctgtcccctgttggccaacctgcctgcaaacatggagggcatttggccacagataggcaggaggagctcagttgtcggacagctatgcagtccctgtccggtggtgctggaggctccactctccttaggttcatagtctctccccttctttcccttccacttctagagcagggaggcttggggaggggaaaatttagctctgggtagctcttaaatcttagcctcagttgtggggtttggtttcatgtgttagataaggccaagacttagagaatcagtgggaaaaaaccttgagatctccaacacgctgggcccctccctggggcggggactctaccttccagattcagtccctagtcttgcgatgaattctgcattgttcggtgttttttgtacatgtcaactcgtaaatctgattaaattgggttcttgagctgc

SEQ ID NO: 202859 - DNA, 2600 bp, Homo sapiens
  Payload ID: 20008
  Gene Name: zinc finger protein 541
  ENST ID: ENST00000595558
  CDS Start-End: 1-2600
ccaaaagcaaaggcaacaacgtgtttgttgtccacaagccctcggccgtgccctcgcgggagggctccgagtctggcccgggacccagcagcggaagcccctcggaggagtccccgcccggccccggcggtggcctggaggatgctctgcccttccctgccgcgctcctcagggtccccgcggaggccccgagcgaccccaggtcggccagcggggaagatgacccctgcgcccccaagaaggtcaaggtcgactgcgactccttcctgtgccagaaccccggggagcccggcctccaggaggcccagaaggcaggcgggctccctgcggatgcctcgccgctcttccgccagctcttcctcaagtcgcaggaacctcttgtgagccacgagcagatgcaggtgttccagatgatcaccaagtcccagcggatcttctcccatgcccaggtggcagcagtctcctcccagctccctgcgcccgagggcaaaccagccgccctgaggccgctgcaggggccgtggccgcagcagcccccaccactggctcctgctgtggactctctccacgccggccctggaaaccccgaggcagagggctccccagcccgcaggagaaaaaccacacccggggttcccagagaggcctcccccggcagcacgagacgagacgcaaaggggggactgaaagtggccgcggttccaacgccccttgcagcaccgtctctggacccttccaggaatccagacatctcttctctggccaagcagctgcgatcctctaaagggaccttggacctggaggacatcttcccctccacaggccaacggcagacccagttaggtggggaggagccaccaggagcctcgctgccagggaagcaggccccagccgagaatggcgcggcttcaaggatcacaaaaggtgaaaagggcccagcctgctcccggggtggaggctaccggctcttgggcaaccccagggccccgcgattctccggcttccggaaagagaaggcgaagatggatatgtgctgtgcggcttctccgagccaggtagccatggcctccttctcatcggccgggcccccggcagatccctccaagtccaagctgacaatattcagcagaatccagggtggaaacatctacaggctcccccatccggtgaaggaagagaatgtggcaggcagaggtaaccagcaaaacggcagtcccacagactggacgaagcccaggagcacttttgtctgcaagaactgcagccagatgttttatacggagaaagggctgagcagccacatgtgttttcacagcgaccagtggccgtcacctcgagggaagcaggaaccgcagggacaagagaaagacggggaggagcgagacagcaaggagagcagccagcagagaaagcggaagaagcggcccccaccctccacggctggggagcctggccctgcaggatgccaccagagccgcctgcggtcacccatgttcctggtggactgcctcctgaagggcttattccagtgctccccctacacaccacccccaatgctcagccccatccgggagggctctggggtgtacttcaacaccctctgttccacgtccactcaggccagccctgaccagctcatcagctccatgctcgatcaagtggatgggtcctttggcatctgtgtggtgaaggatgacaccaaaatcagcattgagccacatatcaatataggaagccggtttcaggcagagatcccggaactccaggagagatccctggctggaactgacgagcatgtagcttctctggtctggaagccatggggagatatgatgatcagctcagagacacaggatagagtgaccgagctctgcaatgtggcatgctccagcgtgatgccaggagggggcaccaacctggagctcgctctgcactgcctgcacgaggctcagggcaacgttcaggtcgccctggagactcttctgctccgagggccccacaagccacggacacacctgctcgctgactatcgctacacaggttcagacgtctggacccctatagagaagaggctttttaagaaggcgttctatgcccacaagaaggacttctacttgatacacaagatgatccagacaaagacggtagctcagtgcgttgagtattattacatctggaaaaaaatgatcaagtttgactgtggccgagccccagggctagaaaagagggtcaagagagagccggaggaagtggaaaggacagaggaaaaggtcccatgcagccctcgggagagacccagccaccatccaactcccaagttaaagaccaagagttataggagggagtccatcctcagctccagcccaaatgcaggctccaagcggacccccgagctgttgggaagtgcagagagccagggcatttttccatgcagagagtgtgaaagggtgtttgacaagatcaagagtcgaaatgcccatatgaagcggcaccgccttcaggaccacgtggagcccatcatcagggtgaagtggccagtgaagcccttccagctaaaggaagaggagctgggagctgacatcggccccctgcagtggtga

SEQ ID NO: 202860 - DNA, 3659 bp, Homo sapiens
  Payload ID: 20009
  Gene Name: zinc finger protein 543
  Uniprot ID: Q08ER8
  ENST ID: ENST00000321545
  CDS Start-End: 346-2148
ggaacagtgtggggcctggaccgctgggtaggcgcgtccagcggcctgagcaggggagggtaatgaggctgttacgcgccttctccgcatcttggcgggagcctgacgccccgcttcttccctaacggggtgttccaccggcgcctgccgaggcctaggcctccgcagccgccctccgtctcctcagccccgacgctgcgcccgctttgtgcgcatttttctctggggaaactgaggctccgagtgcgaaagtcagccgaggtcgccccgcccaggacagagaagggctgggggtcggctgagccgcggcattcccgggccccgctagggctgcagggtctcaggatggcagcctcggcgcaggtgtctgtgacctttgaggatgtggctgtgacattcacccaggaggagtggggacagttggatgcagcccagagaaccttgtatcaggaggtgatgctggagacctgcggacttctcatgtctctgggctgtcctttgttcaaaccagagctgatctaccagttggatcacagacaggagctatggatggctacaaaagacctctcccaaagctcctatccaggtgacaacacaaaacccaagaccacagagcctaccttttctcacctggccttgcctgaggaagtcttactccaggaacaactgacacaaggagcctcaaagaactcccaattagggcaatccaaggatcaggatgggccatctgaaatgcaagaagtccacttgaaaatagggataggcccccagcgggggaagctgctggagaaaatgagttctgaacgtgatggtttggggtcagatgatggtgtatgtacaaagattacacagaaacaagtttcaacagaaggtgatctctatgaatgtgattcacatggaccagttacagatgccttgattcgcgaagagaaaaattcctataaatgtgaggaatgcgggaaagtgtttaaaaagaatgccctccttgttcagcatgaacggattcacactcaagtgaagccctatgaatgcacagagtgtgggaaaacctttagcaagagcactcatcttcttcagcacctcatcatccacactggggagaagccctataagtgcatggagtgtgggaaggcttttaaccgcaggtcacacctcacacggcaccagcggattcacagtggagagaagccttataagtgcagtgaatgtggaaaggccttcacccaccgctccacttttgtcttgcatcacaggagccacactggagaaaaaccctttgtgtgcaaagagtgtggcaaagcctttcgagataggccaggtttcattcgacactacatcatccacacgggagagaagccctatgagtgcattgagtgtgggaaggccttcaaccgccggtcatacctcacgtggcaccaacagattcacactggagtgaaaccctttgaatgcaacgagtgtggaaaagctttttgcgagagtgcagacctcattcaacactacattatccacactggggagaagccctataagtgcatggagtgtgggaaggcgttcaaccgtaggtcacacctcaagcagcatcaacggattcacactggggagaagccttatgaatgcagtgaatgtggaaaggccttcacccactgctccacttttgtcttgcataaaaggacccacacaggagaaaaaccctatgaatgcaaagaatgtggaaaagcctttagtgatagggcagacctcattcgccacttcagcatccacactggagagaaaccctatgagtgcgtggagtgtggaaaggccttcaaccgcagctcacacctcacgaggcaccaacagattcacactggagagaaaccctatgaatgcatccagtgtgggaaagccttttgccggagcgcaaaccttattcgacactccatcattcacactggagagaagccgtatgaatgcagtgagtgtggaaaggcttttaatcgcggctcatccctcacacatcatcaaaggattcatactgggagaaaccctaccattgtaacagatgtgggaagaccttttatgactgcacagacttcagtcaacatccaggaacttttattagggaaagagtttttgaatatcaccactgaagaaaatctgtggtgaaagggaacatcttaccatctggccattcacactgaagagaaacttcataagcatcctctctttgagaaaacgtgtaatagatgatcatttgtcgtctaaacaatcaagttagaaattgaaccagcctggagtcttattctccacctgagaattcacccatgagagagacccagtggttgctatgcacttaggaaaactttcagccacatctttcttcttagtttacagtgaaatattatctcagggatattttttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcctggctaattttttgtatttttagtagagacggggtttcaccgttttagccgggatggtctcgatctcctgacctcgtgatccgcccgcctcagcctcccaaagtgctgggattacaggcgtgagccaccgcgcccggccatctcagggatatttaaacaaaggaagaggaaatatagggaagagaaagaaaccacagcttcttttagacttgtctgacaagcctatggcaattttgtcgtccctttgttattttatgtgggagagggaaatgtttcagaaacgaaagatctcatcccctttatttttctgtgtatgcattcactgctgcccagtgtcagaacagttatacaaacgagggcttgaaaacattttgtgaaaacttgcttagtcctgcaacgttctccactctcgaggtgcagaagcatacatctttataaaaaatatggaggcttgagttatgaaacacttttataaggagataaggatgtacatatgtttggacacattgtccacttcagatgcttgtttaaaaaaatgtttcaccatgtgtctttacccaatacacatactttttcttgatgtggatttactttttttttttttttttaagttttcctgggatagggatgatagtgtaattgttcatgcccacagtaatcctgggaatcttagttttttcctatgattgtggtttctcagcttctttacctctcctttgagttaggtccacctcagttttctaaaggtcaaattaaggcccccccaaaaatacagtatgtagctgaattcctttgaaagatcatgataaactcagaagaacaaacatagaaggaatgtcatttttaatctttttaaagagtgtgtgaaaattcactttaactggaattttaacaggcaagccggcatgcatatatgtagggatgtgtgactttcacagttgtcaccatggacttaggcttgattaaaatgctacacatttagagcgttttgtaattccttttttatatttttaagactagattttgagccatgtgatagttttacctcatattaaatatattgtacagaagtaaaaataatcatgtattcactttgaactcctc

SEQ ID NO: 202861 - DNA, 3547 bp, Homo sapiens
  Payload ID: 20010
  Gene Name: zinc finger protein 544
  Uniprot ID: Q6NX49
  ENST ID: ENST00000269829
  CDS Start-End: 62-2209
agactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcaatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcagtttgcgaggccgaggcaggtggatcacttgagcccaggagtttgaaaccagcctgggtaacatggcaaaatcctgtctttacaaaaaatacaaaaattagcctagcatggtggcgcatacctgtagtcctagctactcaggaggctgaggtgggaggatcacttgagcttgggaggcggtggttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagtaaaatccaggagtctgcagtttctaaaatcacacaggtgagtgggcatggtggctcatgcctgtaatcccagcactttggaaggctgaggtgggtggatcacctgaagtcagaagtttgagaccagcctggcaaacatggcaaaactgtctctattaaaaatacaggccaggggccgggcacggtgcctcacacctgtaatcccagcacttaggtaggccaaggtgggtggatcacgaggtcaggagattgagaccatcctggctaatatggtgaaaccctgtctctactaaaaatacaaaaaaattagctaggcatggtggcgggctcctgtagtcccagctactcaggaggctgaggcaggagaatggcgcgaacatgggaggcgtagcttgcagtgagctgagatcacactactgcactccagcctgggcaacagagcaagactgtctc

SEQ ID NO: 202862 - DNA, 555 bp, Homo sapiens
  Payload ID: 20010
  Gene Name: zinc finger protein 544
  ENST ID: ENST00000597240
  CDS Start-End: 265-555
accggaagcaccgccattggccggtgcgtgcaggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgagacggagtttcgctcttgttgcccagactggagtgcaatggcacaatc

SEQ ID NO: 202863 - DNA, 2274 bp, Homo sapiens
  Payload ID: 20010
  Gene Name: zinc finger protein 544
  ENST ID: ENST00000599953
  CDS Start-End: 351-2072
caggtggcagccaagagcctcctggcacagcggcaccaggcaggtgacgcctattggaccccagaggacactgtaccgagaggtgacactggagacctgggagcatattgtctccctggctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcaatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaaccct

SEQ ID NO: 202864 - DNA, 2818 bp, Homo sapiens
  Payload ID: 20010
  Gene Name: zinc finger protein 544
  Uniprot ID: Q6NX49
  ENST ID: ENST00000596652
  CDS Start-End: 235-2382
caggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcaatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcag

SEQ ID NO: 202865 - DNA, 543 bp, Homo sapiens
  Payload ID: 20010
  Gene Name: zinc finger protein 544
  ENST ID: ENST00000596929
  CDS Start-End: 235-528
caggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgaggaacgaggcccagcaaaaagcagagacggtacagggccagaaggatctgagagagtgtggccagc

SEQ ID NO: 202866 - DNA, 895 bp, Homo sapiens
  Payload ID: 20010
  Gene Name: zinc finger protein 544
  ENST ID: ENST00000595981
  CDS Start-End: 232-651
gtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgagagaaggggatgctgcctgggagctttttgggactcccaatagaagacagatttagtctcctggaaggctgcctgatccagttcccacagcagctgccacttgctcaggaacgaggcccagcaaaaagcagagacggtacagggccagaaggatctgagagagtgtggccagcttgagccctcaggagtcggccagaaggatctgagagagtgtggccagcttgagcccctcgggagtcagctcctccgtccccactggtaacgtcttcaccccttcaacacggtgtgaagggccatgtcatggttgatcttcagtccctcagactacaccatcagccccatgggggtgagcaaataacaagtaactatactgttccctgctatgtgtctggctcttggtaaaatttaaaaaagttaaaaa

SEQ ID NO: 202867 - DNA, 4109 bp, Homo sapiens
  Payload ID: 20010
  Gene Name: zinc finger protein 544
  ENST ID: ENST00000596677
  CDS Start-End: 270-494
caggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcaggtaatggagccagtactttgacagcaggttgcaaaactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgagcctgaagaaatggtagaattggtgcattaagaatatgaagtcagtgttgatgtctgagatgcaattatgagatccagaagtggaacagaaactgatattctaggactaagcaccagttaggagtctgtgtttgcttcctgtggctgctgtaaaaaatttccaccaacctgttggcttaaaacaatgcaaatttattctctaaaagttctggaggccacaagtccaaaatcaatgtcactggatcaaaatcaaggtgttgatatggttgtgctccctctggatgctccaaatggaaaacacatttctgtcttttccttctcctgttggttgcagcattctttccagtcttcagatatcttctgctgtgtcttctcatcacctcctctgtgtttcaaatctccctctgcctttctcctataggaacacttgtgattacatttagagcccccctggatagtacagaaaaaaaatccccatttaaaaatttttagcagggtgtggtagcaggcacctgtactcccaggctcaagcgattctcctgcctcggcctcccgaggagcttagactacaggcgcccaccaccacacctggctaattttttttttatttttattagagatgaggttttaccatgttgaccaagctggtctctaactcctgacctcaggtgatccacctgcctcagcctcccaaagttctgggattacaggtgtgagccactgcacctggcccctccctgcttattcttattcttctgccctctatttggggactagtgttacttagtcacttctttattatgtttgcttgtattttgcactttaccactgataccatgtttgctgatccatccctccctttcacagcctgcatacggattacagtttgtagtttggaaacaaaccagagacacttccattaaacagttgtctccttcatctccccctccccctccccctctgatgcttctccagtaacttaggcattttggatttctttcagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcaatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcagtttgcgaggccgaggcaggtggatcacttgagcccaggagtttgaaaccagcctgggtaacatggcaaaatcctgtctttacaaaaaatacaaaaattagcctagcatggtggcgcatacctgtagtcctagctactcaggaggctgaggtgggaggatcacttgagcttgggaggcggtggttgcagtgagctgtgatcatgccatcacaccgctgccttgtgagagattgagacactctaaataaataataaccaagatggg

SEQ ID NO: 202868 - DNA, 3587 bp, Homo sapiens
  Payload ID: 20010
  Gene Name: zinc finger protein 544
  ENST ID: ENST00000599227
  CDS Start-End: 585-812
gagatgacagcgccgagccccataggcgctagtcccgccctggacgccgaccgccgcctccacagtctcggcttcggttgctggatgagaaccagcgtggcccgtttaagggggaggggacaggcgctgcaaggagcagagccgcgggaagcaactccctaagccacaatgctagtcgcgaacacaggaaaaagctcatcccgccgccgcggggccccatgctcccgccggcaatgactatgcctgtgggagcaacggctaccggcgcgcggccttctgggagttgtttgttgcgcggagcgcgggcacgtccgccggccaccggaagcaccgccattggccggtgcgtgcaggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcaatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcagtttgcgaggccgaggcaggtggatcacttgagcccaggagtttgaaaccagcctgggtaacatggcaaaatcctgtctttacaaaaaatacaaaaattagcctagcatggtggcgcatacctgtagtcctagctactcaggaggctgaggtgggaggatcacttgagcttgggaggcggtggttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagtaaaa

SEQ ID NO: 202869 - DNA, 2837 bp, Homo sapiens
  Payload ID: 20010
  Gene Name: zinc finger protein 544
  ENST ID: ENST00000600220
  CDS Start-End: 235-2298
caggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcaatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcagtttgcgaggccgaggcaggtggatcacttgagcccaggagtttgaaaccagcctgggtaacatggcaaaatcctgtct

SEQ ID NO: 202870 - DNA, 3516 bp, Homo sapiens
  Payload ID: 20010
  Gene Name: zinc finger protein 544
  ENST ID: ENST00000596825
  CDS Start-End: 514-741
ggaggtttcactgttagccgggtgcggccggagcgcaggaccaggccagagccgccccaagtgatctgggcgtgccggagaaacgagcagggcctgcgggggtccctcatgcggcgaggccgagcaagggcaggggcctgatgggatcgggatctctccggcctcagggacggggaaggccggtccagtcaggtttcccctgcaggagcgcccggctgggtctgagcttgtcgggaggctctcctgctgcagagctgggagggaacttatagtacctcgcaggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcaatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcagtttgcgaggccgaggcaggtggatcacttgagcccaggagtttgaaaccagcctgggtaacatggcaaaatcctgtctttacaaaaaatacaaaaattagcctagcatggtggcgcatacctgtagtcctagctactcaggaggctgaggtgggaggatcacttgagcttgggaggcggtggttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagtaaaa

SEQ ID NO: 202871 - DNA, 588 bp, Homo sapiens
  Payload ID: 20010
  Gene Name: zinc finger protein 544
  ENST ID: ENST00000594384
  CDS Start-End: 265-492
accggaagcaccgccattggccggtgcgtgcaggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctcttt

SEQ ID NO: 202872 - DNA, 2784 bp, Homo sapiens
  Payload ID: 20010
  Gene Name: zinc finger protein 544
  ENST ID: ENST00000600044
  CDS Start-End: 270-2333
caggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcaggtaatggagccagtactttgacagcaggttgcaaaactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcaatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgta

SEQ ID NO: 202873 - DNA, 383 bp, Homo sapiens
  Payload ID: 20010
  Gene Name: zinc finger protein 544
  ENST ID: ENST00000627781
  CDS Start-End: 63-383
cagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgaggtacttcaggtctttcacaagtcacaggtgtagtggctgatgggagcttcaggttcccggtctgggacttcacataa

SEQ ID NO: 202874 - DNA, 7987 bp, Homo sapiens
  Payload ID: 20011
  Gene Name: zinc finger protein 546
  Uniprot ID: Q86UE3
  ENST ID: ENST00000347077
  CDS Start-End: 217-2727
caagggccctttacattgcgttcttaacggttcagtcaccttaaccgttattattcacttgcgggcgagaagtccgagctagggatcctgaaaaggagggaacaattgttgtagcaggtctaaaagttcaggtccaggaaatggaaacattgctttgcttttcctgaattgtccagtgacctatcccaggccttcctttccagtgaacaatggaccatgcaggtggaccctcctcttcacgggcctccaaatgactttctcatttttcaaatcattcctctgcactcactttctataatgccccggtttctctggattctgtgcttctccatggaggaaactcaaggagaactgacaagttcttgtggttctaaaaccatggccaatgtatctttggcatttagggatgtgtccatagacctctcccaagaggagtgggagtgcctggacgctgtgcagagggacttgtacaaggatgtgatgttggagaactacagcaacctggtctcactgggatataccattcctaagccagatgtgattactttattggagcaagagaaagagccctggatagtaatgagggaagggacaaggaattggttcacagatttggaatacaagtatattaccaagaatttgctttcagaaaagaatgtttgcaaaatctatttatctcaattgcagacaggggaaaaaagtaaaaacaccatccatgaggacaccattttcagaaatggtttgcagtgtaaacatgaatttgagagacaagagagacatcagatgggatgcgttagtcaaatgctaatccaaaaacaaatatctcatcctctacatccaaaaattcatgctagagagaaatcatatgaatgtaaggaatgtagaaaggcctttagacaacagtcataccttattcaacatctgagaattcacactggtgagagaccctataaatgtatggaatgtggaaaggccttttgtcgagtgggagaccttagagtacatcacacaatccatgctggggagagaccctatgaatgtaaagaatgtgggaaggcctttagacttcattatcaccttactgaacatcagagaatacattctggtgtgaaaccctacgagtgtaaggaatgtgggaaagcctttagtcgtgttagagaccttagagtacatcagacaattcatgctggagagagaccttatgaatgtaaagaatgtgggaaggcctttagacttcattatcaactaactgaacatcaaagaattcatactggtgagaggccttatgaatgtaaggtttgtggcaagacctttagggtacaacgacatattagtcaacatcagaaaattcatactggtgtcaaaccctataaatgtaatgaatgtgggaaggcctttagtcatggctcataccttgttcaacatcagaaaattcatactggtgaaaaaccctacgaatgtaaagaatgtggtaagtcctttagttttcatgcagaacttgctcgacatcgtagaattcatactggtgagaaaccctatgaatgtagagaatgtggaaaagcctttcgtcttcaaacggaacttactcggcatcatagaactcatactggtgagaaaccctatgaatgtaaggaatgtgggaaggcctttatttgtggttatcaacttactttacatctgagaactcacaccggtgagattccctatgaatgtaaggaatgtggaaaaaccttcagtagtcgctatcatctcactcaacactacagaattcatactggtgagaaaccctacatatgtaacgaatgtggaaaagcctttcgtcttcaaggagaacttacccgacatcacagaattcatacatgtgagaaaccctatgaatgtaaggaatgtgggaaggcttttattcatagcaatcaatttatttcacaccagcgaattcacaccagtgagagcacctacatatgtaaagaatgtgggaagatttttagtcgtcgctataatcttactcaacattttaaaattcatactggtgaaaaaccctacatatgtaatgaatgtgggaaagcctttcgatttcaaacagaacttactcagcatcacagaattcatactggtgaaaaaccctataaatgtacagaatgtgggaaggcctttattcgtagcactcatctcacgcaacatcacagaattcatactggtgagaaaccctacgaatgtacggaatgtgggaagacgtttagtcggcactatcatcttactcaacatcacagaggccatactggtgagaagccctacatatgtaatgaatgtgggaatgcttttatttgcagttatcgacttacattacatcaaagaattcacactggtgagcttccatatgaatgtaaggaatgtggaaagacctttagtcgtcggtatcatcttactcaacattttagacttcatactggtgagaaaccttatagctgtaaagaatgtgggaatgcctttcgtcttcaagcagaacttactcgacatcacatagttcacacgggtgagaaaccctataaatgtaaagaatgtgggaaagccttcagtgttaattcagaacttactcgacatcacagaattcatactggtgaaaaaccctatcaatgtaaagaatgtggaaaagcctttattcgtagtgatcaacttactttacatcagagaaatcatattagtgaggaagtcctatgcataatgtaaagagaatacgatggcctttagaaaatgccctttagcagagaatttgtaatttaagaaattttctgtttgttacggaacatgtgggaatcccttttacttcatgctcacaatttatcagaaattatttcgtatgttaaagagtcgaaagactatagcatcactcagtccctgttagactttagaagattgatactgatgcactgcatcccaaaccatcaagggccttttcccctacaaactgttgttgaacagtgcttctctaaaatgcaataataatgggccaggtgaagtggctcacacctgtaatcccagcactgtggaaagacaggagttcgaaaccagcctgggcaacatagtgagaccctgcctcatggctttagtgagccatgattgtgccactgcactccagcttggtgacagagtgagatcctgtctctaaataaataaataaaatgcgggccaggcacagtggctcacacctgtaatcccagcactatgggaggcccaggtgagcagatcacctgaggtcaggagttcaagaccagcctggccaacatggtgaaaccccttctctactaaaatacacaaattagctaggcattgtggggggtgcctgtaatcccagctactcaggaggctgaggcaggaaaattgcatgaacctaagtggcagaggttgcagtgagctgagatcgcaccactgcactctagcttgggcaacagagcaagactctgtctcttaaataaataaataaatagattaccagaaaaatgaaaagaaaaaaacagacatacaaaataaaagccccagttttttattatggtatttaactgagttaactctgtcagattgctgcaaacatttctaaatacttgctcttggtatctataacttttgcagagaccagaagcaaacaatttgtgggccagtgtcaacacatggaccacactttatatagcactgtaacggaaaatgattctgttaatgtaatgaacatgggaaagaccagccttggcctatctttatgatatatataaataatataattctcataattccacctctgcctatgtggtgtttggcaaaacatgcccctgtgccttggtttttaaaatggtaataacagtaccacctaatagtatttttgtgaggatgaaatgctaataaaagataaaacctttaaaagagtatttggcacacagcattttatcaataaatattgctttatttttttcattggggatacatttagtacattcatgtgagaggaaggccctgtgggtgtaagaaatttgtaaaaactgtccattacctttcactccttatttagattggaataattaactggagataatatccagtaaaatagattaaacttccatttataaagtcagaacctatctctgaaaattaatgtgagaaagaaatctctagatttgatgggtgtgaagattatgagagtaaagttttgaagactcagggatagctgtaatgcttttttctttttataacccaaaaagcaggtatgtcagtcgctttttctgcccacaatgataaattaaaaacagccactatccatttggaaaacttaaaagaataatgaacagttatgttctatctagattcagcaattgttaatatgttgtcacatttggtttgcttatacataatatttacatattttgctgtagtatttgagtataaattgcagatactataacacatcacatctaagaataaaggctgcctcctacttaattgctatataacaattgtccaacctgtctgtgccccagggcagctttgaatgcagtccaacagaaatttgtaagctgtcttaaaacatgagattttttttgtgattttttttaagctcatccgccattgttagcacattttatgtgtagcccaagataattcttcttccagtgtaacccagggaagccaaaagatttgacccccagtaacttcacacctaaggagattagcaataattccataatctgtaatattcagtctgtgttcatattctcagttgtgttcattcttttcatttgtgtaaacaatgcttttcataggttatttttaaattcaggaaccaaattcatgaattacatttgtgcattgttcgtctcttttaaagtaagaatggcccttccccccacaactttattgcaacattgactttttttttttttttttttttttttttttgagatggagtctctgtcgcccaggctggagtgcagtggtgcgatcttggctcactgcaagctccgcctcccgggttcaggcaattctgcctcagcctccccagtagctgggactacaggcgccttcaaccatgcccggctaattttttgtatttttagtagagacggggtttcaccatgttagccaggacggtctcgatctcctgacctggtgatctgcccgcctcagcctcccaaagtgctgggattacaggcatgagccaccgcacccggccttcccaaagtatttttaaatgtgcttttttatccccagtatttcccattaactggaatttgggattagagacccaattagggacagattaaatattttggcaagaatacttaatgggagaaattttgtatttcaatttgtaacccattaggtggcatacaatgtcattataccactatggtatccttagttcattcacttggtgtagcagaacatacattccaaagatggccacaccaatatatcccattctgcatgttcatcttacaatgtgataccaacactccccaagaggtagagctcatggtccttccttttgaatctggccaggtgggcctgtgtttatggcaggaataacactgtgatttccacgactaagtcataaaaggcaatacagcttctgcctgacccacttgggatgaagcccagccaccatgctatgaagatgccaagtaatcacatagaaaagctaagtaaagctgtcctgattacagctgtaattgaggtaacagccgggatccagcaccaagtgtatgagggtatgagccttcagatgattctaacccttagccttcaggctatcctagctggtgctaagtggagcagagaaaagctttcccccatgagcctgcccaaattgcagatttacgtttaaaatatggcctgttttaagccactaagttttggagtagtttgccacacagcgataggtaactgaaatacttgcttcatatggtaatcaccaggtttctctgttgtagagctaaatatttcttttaatttagtaaacgatctgtagagtagtactttggcatttcggaaatttaaaatctccaataatataatgacactagatcaaaaagaaaatgaaaccataaaggacaatttagaaatgaatggtaagatcagaatttgtgaatgtggccaaacctgtgctcagtgaaaaatcagtaacctgttaatatattcaggaaacaaatattgagggccagcactttgtttctcctgctcaccactctactcccagtgacttaatactgtctctttaacatagtaatcacttataaaactgttaaaagaatgaagaagcattaaactcaagaaactaagggaaaaataagtcaatataagaaagaagggaggatcattaaaaggagttaatgaatttgaaaataaaatagacttattaaggctttgtgaaaaaatattaatacttgattttagtatagctaatcaaaggaaaaagataattacagcattgtgaatgagaattggatgtaagtacagatggaggagatattttttgttttattgaaaatttcaaggaggaagtaatatcaaaatttcactagctctttctacactgatattataatcctgataatacaacagatgaggatagttcttaaaaggcaaaaatgtaggtgagtcattacgaagaaagcagaaattctaaaccatcagcacattcattcaaaaacctagtaaagcaattaagcaaaataatttgtttacttggactgtccagggatagatctgttctagttttccaaattaatgatgggaaaggaagagctgatccagtccaagtatcttcaagatccatgttctcagtttttcttagctttaaatggccaaattgtggcttagattggatatgataatttcctcaatgcttaacactgagcacaatttttcacatatttgaaatcaaggtgtatcttacaatttatggcatctgacaatacttccaaccaggtggcagtcatcaagcagttttgtgaaaagccttcccggtaagaatacaaaagcatctgcaccaaaatatatagatttaatggcatgtaggggtttgcgtgaatatatacagttgaaattcaattcttccttaaaaataattgtaactcatttctttaagactaccatactaccactttcctcaacttggactaatgtccattgtcaaccaaaatgtctgtgatctcatggatccattatgatttgcaactccaggtccattttatgcaaataagacagccataatatatcattgtacaagtcatttactatctaattatatcattgctcaacatttgcaaattatttttacaaataacaataattggatgtaacaaaaagcagagtattttgagacgtatattaatgcaaaatattgttaatgtatcagtggattgttcctccaaagtaccagtgccttaacacaacatatctaaaagaacatctctgggaacagtagtacttaatggcaacttgagaattggtttgtgggcacacagccttgtgaagttttgaatactaaatcccttttttaaaaaagtgcttattatcaggctatcaatcaaaagatttgagtctttcagtaaagaaaatttgcttaattttatctagtgcatgataaactttactaaggaagtctcattcagaatatctaatattttggatgtgagcccacactggaaatgccataaccaaaaaagagtgaccctaaagatagaatattcagatctaatggcagatgcttagctatgctgggaaaggaagtgaattgtatattgctctgctgctcacatattcctctgcaataaattgctggcccagtttagtttttatatactcactactatactaatgaggatggctcaattttttatttgaacgtactataatgaatttaaactttcattggtatttatgttttaacaggttttcactatttcaaatatacttcaataaatatccttgtctgtgatca

SEQ ID NO: 202875 - DNA, 561 bp, Homo sapiens
  Payload ID: 20011
  Gene Name: zinc finger protein 546
  ENST ID: ENST00000601138
  CDS Start-End: 184-561
agtgttgcctggaccccaagggccctttacattgcgttcttaacggttcagtcaccttaaccgttattattcacttgcgggcgagaagtccgagctagggatcctgaaaaggagggaacaattgttgtagcaggtctaaaagttcaggtccagccccggtttctctggattctgtgcttctccatggaggaaactcaaggagaactgacaagttcttgtggttctaaaaccatggccaatgtatctttggcatttagggatgtgtccatagacctctcccaagaggagtgggagtgcctggacgctgtgcagagggacttgtacaaggatgtgatgttggagaactacagcaacctggtctcactgggatataccattcctaagccagatgtgattactttattggagcaagagaaagagccctggatagtaatgagggaagggacaaggaattggttcacagagtctcgctctgtcacccaggctggagtgcagtggcacaatctcggctcactgcaacctccacctcccgggttcaagcaattcttctgcctcagcctc

SEQ ID NO: 202876 - DNA, 626 bp, Homo sapiens
  Payload ID: 20011
  Gene Name: zinc finger protein 546
  ENST ID: ENST00000599504
  CDS Start-End: 208-626
acatttcccagaagccccttgggcagtgttgcctggaccccaagggccctttacattgcgttcttaacggttcagtcaccttaaccgttattattcacttgcgggcgagaagtccgagctagggatcctgaaaaggagggaacaattgttgtagcaggtctaaaagttcaggtccagccccggtttctctggattctgtgcttctccatggaggaaactcaaggagaactgacaagttcttgtggttctaaaaccatggccaatgtatctttggcatttagggatgtgtccatagacctctcccaagaggagtgggagtgcctggacgctgtgcagagggacttgtacaaggatgtgatgttggagaactacagcaacctggtctcactgggatataccattcctaagccagatgtgattactttattggagcaagagaaagagccctggatagtaatgagggaagggacaaggaattggttcacagatttggaatacaagtatattaccaagaatttgctttcagaaaagaatgtttgcaaaatctatttatctcaattgcagacaggggaaaaaagtaaaaacaccatccatgaggacaccattttcagaaatggtttgcagtg

SEQ ID NO: 202877 - DNA, 3426 bp, Homo sapiens
  Payload ID: 20011
  Gene Name: zinc finger protein 546
  ENST ID: ENST00000600094
  CDS Start-End: 230-2662
gttgcctggaccccaagggccctttacattgcgttcttaacggttcagtcaccttaaccgttattattcacttgcgggcgagaagtccgagctagggatcctgaaaaggagggaacaattgttgtagcaggtctaaaagttcaggtccaggaaatggaaacattgctttgcttttcctgaattgtccagtgacctatcccaggccttcctttccagtgaacaatggaccatgcagccccggtttctctggattctgtgcttctccatggaggaaactcaaggagaactgacaagttcttgtggttctaaaaccatggccaatgtatctttggcatttagggatgtgtccatagacctctcccaagaggagtgggagtgcctggacgctgtgcagagggacttgtacaaggatgtgatgttggagaactacagcaacctggtctcactgggatataccattcctaagccagatgtgattactttattggagcaagagaaagagccctggatagtaatgagggaagggacaaggaattggttcacagatttggaatacaagtatattaccaagaatttgctttcagaaaagaatgtttgcaaaatctatttatctcaattgcagacaggggaaaaaagtaaaaacaccatccatgaggacaccattttcagaaatggtttgcagtgtaaacatgaatttgagagacaagagagacatcagatgggatgcgttagtcaaatgctaatccaaaaacaaatatctcatcctctacatccaaaaattcatgctagagagaaatcatatgaatgtaaggaatgtagaaaggcctttagacaacagtcataccttattcaacatctgagaattcacactggtgagagaccctataaatgtatggaatgtggaaaggccttttgtcgagtgggagaccttagagtacatcacacaatccatgctggggagagaccctatgaatgtaaagaatgtgggaaggcctttagacttcattatcaccttactgaacatcagagaatacattctggtgtgaaaccctacgagtgtaaggaatgtgggaaagcctttagtcgtgttagagaccttagagtacatcagacaattcatgctggagagagaccttatgaatgtaaagaatgtgggaaggcctttagacttcattatcaactaactgaacatcaaagaattcatactggtgagaggccttatgaatgtaaggtttgtggcaagacctttagggtacaacgacatattagtcaacatcagaaaattcatactggtgtcaaaccctataaatgtaatgaatgtgggaaggcctttagtcatggctcataccttgttcaacatcagaaaattcatactggtgaaaaaccctacgaatgtaaagaatgtggtaagtcctttagttttcatgcagaacttgctcgacatcgtagaattcatactggtgagaaaccctatgaatgtagagaatgtggaaaagcctttcgtcttcaaacggaacttactcggcatcatagaactcatactggtgagaaaccctatgaatgtaaggaatgtgggaaggcctttatttgtggttatcaacttactttacatctgagaactcacaccggtgagattccctatgaatgtaaggaatgtggaaaaaccttcagtagtcgctatcatctcactcaacactacagaattcatactggtgagaaaccctacatatgtaacgaatgtggaaaagcctttcgtcttcaaggagaacttacccgacatcacagaattcatacatgtgagaaaccctatgaatgtaaggaatgtgggaaggcttttattcatagcaatcaatttatttcacaccagcgaattcacaccagtgagagcacctacatatgtaaagaatgtgggaagatttttagtcgtcgctataatcttactcaacattttaaaattcatactggtgaaaaaccctacatatgtaatgaatgtgggaaagcctttcgatttcaaacagaacttactcagcatcacagaattcatactggtgaaaaaccctataaatgtacagaatgtgggaaggcctttattcgtagcactcatctcacgcaacatcacagaattcatactggtgagaaaccctacgaatgtacggaatgtgggaagacgtttagtcggcactatcatcttactcaacatcacagaggccatactggtgagaagccctacatatgtaatgaatgtgggaatgcttttatttgcagttatcgacttacattacatcaaagaattcacactggtgagcttccatatgaatgtaaggaatgtggaaagacctttagtcgtcggtatcatcttactcaacattttagacttcatactggtgagaaaccttatagctgtaaagaatgtgggaatgcctttcgtcttcaagcagaacttactcgacatcacatagttcacacgggtgagaaaccctataaatgtaaagaatgtgggaaagccttcagtgttaattcagaacttactcgacatcacagaattcatactggtgaaaaaccctatcaatgtaaagaatgtggaaaagcctttattcgtagtgatcaacttactttacatcagagaaatcatattagtgaggaagtcctatgcataatgtaaagagaatacgatggcctttagaaaatgccctttagcagagaatttgtaatttaagaaattttctgtttgttacggaacatgtgggaatcccttttacttcatgctcacaatttatcagaaattatttcgtatgttaaagagtcgaaagactatagcatcactcagtccctgttagactttagaagattgatactgatgcactgcatcccaaaccatcaagggccttttcccctacaaactgttgttgaacagtgcttctctaaaatgcaataataatgggccaggtgaagtggctcacacctgtaatcccagcactgtggaaagacaggagttcgaaaccagcctgggcaacatagtgagaccctgcctcatggctttagtgagccatgattgtgccactgcactccagcttggtgacagagtgagatcctgtctctaaataaataaataaaatgcgggccaggcacagtggctcacacctgtaatcccagcactatgggaggcccaggtgagcagatcacctgaggtcaggagttcaagaccagcctggccaacatggtgaaaccccttctctactaaaatacacaaattagctaggcattgtggggggtgcctgtaatcccagctactcaggaggctgaggcaggaaaattgcatgaacctaagtggcagaggttgcagtgagctgagatcgcaccactgcactctagcttgggcaacagagcaagactctgtctcttaaataaataaataaatagattacc

SEQ ID NO: 202878 - DNA, 714 bp, Homo sapiens
  Payload ID: 20011
  Gene Name: zinc finger protein 546
  ENST ID: ENST00000596894
  CDS Start-End: 257-370
acatttcccagaagccccttgggcagtgttgcctggaccccaagggccctttacattgcgttcttaacggttcagtcaccttaaccgttattattcacttgcgggcgagaagtccgagctagggatcctgaaaaggagggaacaattgttgtagcaggtctaaaagttcaggtccaggaaatggaaacattgctttgcttttcctgaattgtccagtgacctatcccaggccttcctttccagtgaacaatggaccatgcagagtctcgttctgttgcccaggctggagtgcagtgatgtgatcttggcttactgcaacctccatctcccaggaaaattgcatgaacctaagtggcagaggttgcagtgagctgagatcgcaccactgcactctagcttgggcaacagagcaagactctgtctcttaaataaataaataaatagattaccagaaaaatgaaaagaaaaaaacagacatacaaaataaaagccccagttttttattatggtatttaactgagttaactctgtcagattgctgcaaacatttctaaatacttgctcttggtatctataacttttgcagagaccagaagcaaacaatttgtgggccagtgtcaacacatggaccacactttatatagcactgtaacggaaaatgattctgttaatgtaatgaacatgggaaagaccagccttggcctatctttatga

SEQ ID NO: 202879 - DNA, 542 bp, Homo sapiens
  Payload ID: 20011
  Gene Name: zinc finger protein 546
  ENST ID: ENST00000595225
  CDS Start-End: 169-542
ctggcgtgtcgtgcccgcagggagcctcaggcctggatcctgaaaaggagggaacaattgttgtagcaggtctaaaagttcaggtccaggaaatggaaacattgctttgcttttcctgaattgtccagtgacctatcccaggccttcctttccagtgaacaatggaccatgcaggtggaccctcctcttcacgggcctccaaatgactttctcatttttcaaatcattcctctgcactcactttctataatgccccggtttctctggattctgtgcttctccatggaggaaactcaaggagaactgacaagttcttgtggttctaaaaccatggccaatgtatctttggcatttagggatgtgtccatagacctctcccaagaggagtgggagtgcctggacgctgtgcagagggacttgtacaaggatgtgatgttggagaactacagcaacctggtctcactgggatataccattcctaagccagatgtgattactttattggagcaagagaaagagccctggatagtaatgagggaagg

SEQ ID NO: 202880 - DNA, 626 bp, Homo sapiens; identical to SEQ ID NO: 202876
  Payload ID: 20011
  Gene Name: Zinc finger protein 546
  ENST ID: ENST00000631242
  CDS Start-End: 208-626

SEQ ID NO: 202881 - DNA, 542 bp, Homo sapiens; identical to SEQ ID NO: 202879
  Payload ID: 20011
  Gene Name: Zinc finger protein 546
  ENST ID: ENST00000626396
  CDS Start-End: 169-542

SEQ ID NO: 202882 - DNA, 561 bp, Homo sapiens; identical to SEQ ID NO: 202875
  Payload ID: 20011
  Gene Name: Zinc finger protein 546
  ENST ID: ENST00000628247
  CDS Start-End: 184-561

SEQ ID NO: 202883 - DNA, 7987 bp, Homo sapiens; identical to SEQ ID NO: 202874
  Payload ID: 20011
  Gene Name: Zinc finger protein 546
  ENST ID: ENST00000626389
  CDS Start-End: 217-2727

SEQ ID NO: 202884 - DNA, 3426 bp, Homo sapiens; identical to SEQ ID NO: 202877
  Payload ID: 20011
  Gene Name: Zinc finger protein 546
  ENST ID: ENST00000627583
  CDS Start-End: 230-2662

SEQ ID NO: 202885 - DNA, 714 bp, Homo sapiens; identical to SEQ ID NO: 202878
  Payload ID: 20011
  Gene Name: Zinc finger protein 546
  ENST ID: ENST00000629260
  CDS Start-End: 257-370

SEQ ID NO: 202886 - DNA, 2739 bp, Homo sapiens
  Payload ID: 20012
  Gene Name: zinc finger protein 547
  Uniprot ID: Q8IVP9
  ENST ID: ENST00000282282
  CDS Start-End: 151-1359
agtgacacaggcacaactgacagtggcagaagctcagctgacaaggactggggacggcggtgtccttgtcttgcctttgtcgcccccgcccctctcttccctggctggacttgcggagtccccgccgaagaacccgagggtcccctggcgatggcagaaatgaaccctgcacagggtcatgtggtttttgaagacgtggccatatatttctcccaggaggagtgggggcatctcgatgaggctcagagattgctgtaccgtgatgtgatgctggagaatttggcccttttgtcctcactaggttgttgccatggagctgaggatgaggaggcacctttagagccaggtgtttctgtaggagtgtcacaggtcatggctccaaagccctgtctatctacccagaatacccagccctgtgagacatgtagctcacttctgaaggacattctgcgtctggctgagcatgacggaacacaccccgagcagggactgtacacgtgtccagcacatcttcaccagcaccaaaaggagcagattagagagaaactttctagaggggatggaggaagaccgacatttgtgaagaaccacagagttcacatggcagggaagaccttcttgtgcagtgaatgtgggaaagcctttagccacaaacataaactttctgaccatcagaaaatccacactggagaaagaacttataagtgcagcaaatgtgggatattgtttatggaaaggtccacactcaatagacatcagagaactcacactggagaaaggccttatgagtgcaatgaatgtgggaaagcctttctttgtaagtctcaccttgttcgtcaccagacaatccactctggagaaaggccttatgagtgcagtgaatgtgggaaattgtttatgtggagttccacactcattacacatcagagggttcacactggaaagaggccttatggttgcagtgaatgtgggaagttctttaagtgcaactcaaacctctttaggcattacagaattcatacaggaaaaaggtcttatggttgcagtgaatgtgggaaattctttatggaaaggtctacactcagtagacatcagagagttcacactggagaaaggccttatgagtgcaatgaatgtgggaaattcttcagcttgaaatccgtcctcattcaacaccaaagagttcacactggagaacggccttatgaatgcagtgagtgtgggaaggccttccttacaaagtcccacctcatttgtcatcagacagttcacactgcagcaaagcagtgcagtgaatgtgggaaattctttaggtataactctacacttctcagacatcagaaagtccacactggataaggcccttatgaatgcagtggatatgggaaagccttcagtcaccaacatattgtggctggacagcaggcagtacacactggagaaagactgaatgccgtgaacgtgggtaattatgtaggtacagctctccagtcgctatgtatcagagaattcacactgcagaaatgtgtgttcagcaaactcgggacattattttggtttgactctcatctcattagacattggagagtttacactgaagaagagtcttttcaataaagtagaaagtggtaaagattcaacatgcaagattgtacttattgggcttcagaatatccacactagtgaaagtcttctgagtacagcaaatgtgtgacattattttgctactactccacactacttagacatcatgtagttcacactggaaaaaggccacgtatgtgccttgaatgtagccaaaatgacgaacaacacccagaaatctgtgatttagcactgagaactagtattatatggtttttaaaaaacaatggtgaagtacatgccacataaaatttgccatcttaactattgtaatgtcttgtttaatacttgaagtacattaacattgttgagcaaagaatatcctgaactctttatcttgtaaaatgaaactctataaccaccattaaaaaaacaactcattcccacattcttcagtccctggcgaccaccatatttttaagtcattatgactctgactattcttggtacttctcagaagaagaatcttagagtgtttttcattattttttttcacttaggataatatcctcaaagttcattcattttttagcatgtgtcagaaattttaaggctgagcaatatttcattgtttgcatttaccacatttcctttatttctgacatctattcatggacacttgggttacttctacctctggctattgtgaatattgctactacaagcataagggcacaaatatctctttgagaccctgctttcaattcttattgggtaccccaaaaagtggaactgctggatcacatggtacttctaactttaattctttgatgaactgagaaacttttccataaaacttgcaccgttttacattcctaacattccacaaaagttgtgatttgtcctcattctaatccatagaaggcaacatttctaacaggtttctaggtgattttgttgttgctgatgtagggactacattttgagaactgtcctatcccatttttataacaatgcagagcttctctgtaaataccccttgtttctatgttctatcctgtgagccttttcattttgttaatttttcccagtgtttacaaccaggaaatagcttgtcatctttgatacaaaacagaaatctttgcaaaataccaa

SEQ ID NO: 202887 - DNA, 602 bp, Homo sapiens
  Payload ID: 20012
  Gene Name: zinc finger protein 547
  ENST ID: ENST00000599604
  CDS Start-End: 478-602
aaacactacataattgatttgacccaaatttgcctataattatcaacataccatggaaaattttagtatcctctaaaattttaaaagctaaaaatatacacctcagtttttgaaattctactacatcatttatactgaaaacatatagtaaaccattaatccaagaacagtaatagctgatatatatgatgagcaacgagtgtttgacaccggtaagagtcctatgaggtgggagccattcttacaacctatttacagatgagagcactgaagctccagcaggttcagttcttttctagagtcacagtgctgctaagagccaacagtgaagtcggaggagctgagtttatacaatcaacttgagatcagtttgctttagggtaaggaagaagagatggtggtccaactctgcctgtaagatcttcccatcgttgcccatttctcacggtttccctcttccttcagggtcccctggcgatggcagaaatgaaccctgcacagggtcatgtggtttttgaagacgtggccatatatttctcccaggaggagtgggggcatctcgatgaggctcagagattgctgtaccgtgatgtgatgctgga

SEQ ID NO: 202888 - DNA, 570 bp, Homo sapiens
  Payload ID: 20012
  Gene Name: zinc finger protein 547
  ENST ID: ENST00000597567
  CDS Start-End: 127-570
gtgcccaggatggtaggggagatggaaacacatttagctgttagtttgtccctgtgtttaatgggtggtaaatataagtagaaaataaatagagaacttaagtaaatacagtttgaaaagctgctcatgtattcatctttcccaatttggcagggtcatgtggtttttgaagacgtggccatatatttctcccaggaggagtgggggcatctcgatgaggctcagagattgctgtaccgtgatgtgatgctggagaatttggcccttttgtcctcactaggttgttgccatggagctgaggatgaggaggcacctttagagccaggtgtttctgtaggagtgtcacaggtcatggctccaaagccctgtctatctacccagaatacccagccctgtgagacatgtagctcacttctgaaggacattctgcgtctggctgagcatgacggaacacaccccgagcagggactgtacacgtgtccagcacatcttcaccagcaccaaaaggagcagattagagagaaactttctagaggggatggaggaagaccgacatttgtgaagaaccac

SEQ ID NO: 202889 - DNA, 596 bp, Homo sapiens
  Payload ID: 20012
  Gene Name: zinc finger protein 547
  ENST ID: ENST00000595335
  CDS Start-End: 240-377
gttccggcctttggcgctctatgacgtcaccgaagtgacggagcggaaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgagggtcccctggcgatggcagaaatgaaccctgcacagatggagtcttgctgtgttgtcacccaggctggagtgcagtggcatgatcttggctcactgcaacctgcacctcctggattcaagcagttctgcctcaatctcccaagtagctaggactacagggtcatgtggtttttgaagacgtggccatatatttctcccaggaggagtgggggcatctcgatgaggctcagagattgctgtaccgtgatgtgatgctggagaatttggcccttttgtcctcactaggttgttgccatggagctgaggatgaggaggcacctttagagccaggtgtttctgtaggagtgtcacaggtcatggctccaaagc

SEQ ID NO: 202890 - DNA, 2115 bp, Homo sapiens
  Payload ID: 20013
  Gene Name: zinc finger protein 548
  Uniprot ID: Q8NEK5
  ENST ID: ENST00000336128
  CDS Start-End: 204-1841
gtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgagggtcccctggcgatggcagaaatggaccctacacagggccgtgtggtctttgaggacgtggccatatatttctcccaggaggagtgggggcaccttgatgaggctcagagattgctgtaccgtgatgtgatgctggagaatttggcccttttgtcctcactaggttcttggcatggagctgaggatgaggaggcaccttcacagcaaggtttttctgtaggagtgtcagaggttacagcttcaaagccctgtctgtccagccagaaggtccaccctagtgagacatgtggcccacccttgaaagacattctgtgcctggttgagcacaatggaattcatcctgagcaacacatatatatttgtgaggcagagctttttcagcacccaaagcagcaaattggagaaaatctttccagaggggatgattggataccttcatttgggaagaaccacagagttcacatggcagaggagatcttcacatgcatggagggctggaaggacttaccagccacctcatgccttctccagcaccagggccctcaaagcgagtggaagccatacagggacacagaggacagagaagcctttcagactggacaaaatgattacaaatgtagtgaatgtgggaaaaccttcacctgcagctattcatttgttgagcaccagaaaatccacacaggagaaaggtcttatgaatgtaacaaatgtgggaaattctttaagtacagtgccaatttcatgaaacatcagacagttcacactagtgaaaggacttatgagtgcagagaatgtggaaaatcctttatgtacaactaccgactcatgagacataagcgagttcacactggagaaaggccttatgagtgcaacacatgtgggaaattctttcggtacagctccacatttgttagacatcagagagttcacaccggagaaaggccgtatgagtgcagggaatgtgggaaattctttatggacagctccacactcattaaacatcagagagttcacaccggagaaagaccttataagtgcaatgattgtgggaaattttttaggtatatctccacactcattagacatcagagaattcacactggagaaaggccttatgagtgcagtgtatgtggggaattgtttaggtacaactccagccttgttaaacattggagaaatcacactggagaaaggccttataaatgcagtgaatgtgggaaatcatttaggtaccactgcaggctcattagacaccagagagtccacacgggagaaaggccttatgagtgcagcgaatgcgggaaattctttcgttacaactccaacctcattaaacattggagaaatcacactggagaaaggccttacgagtgcagagagtgtgggaaagcctttagccacaagcatatacttgttgagcaccagaaaatccacagtggagaaagaccttatgagtgcagcgaatgccagaaggcctttattagaaagtctcacctggttcatcaccagaaaatccacagtgaagagaggcttgtgtgctccatgaatgtggggaattctttagctaaaactccaacctcattaaacatcagagatttcacaatggagaaagtttaccattgactattgtaattgggtagtaatgttatataaattccacatttttatgcaactaatctccagaacatttttcctcttaccaagaagtaaaatgctgtacccattaacaacaactcattccccttccctacttccccagaaatgtctcaactatatttctatactctatggtacttatatgaggtaccaatagatatctatgaatttgatatatatttgtacctcatataagtggattctacagtatttatcttttgagactggcttatttcactta

SEQ ID NO: 202891 - DNA, 4955 bp, Homo sapiens
  Payload ID: 20013
  Gene Name: zinc finger protein 548
  Uniprot ID: Q8NEK5
  ENST ID: ENST00000366197
  CDS Start-End: 251-1852
gggcgggacttccgccgtcctcctggtggtggtcgttttggttctgtgtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgagggccgtgtggtctttgaggacgtggccatatatttctcccaggaggagtgggggcaccttgatgaggctcagagattgctgtaccgtgatgtgatgctggagaatttggcccttttgtcctcactaggttcttggcatggagctgaggatgaggaggcaccttcacagcaaggtttttctgtaggagtgtcagaggttacagcttcaaagccctgtctgtccagccagaaggtccaccctagtgagacatgtggcccacccttgaaagacattctgtgcctggttgagcacaatggaattcatcctgagcaacacatatatatttgtgaggcagagctttttcagcacccaaagcagcaaattggagaaaatctttccagaggggatgattggataccttcatttgggaagaaccacagagttcacatggcagaggagatcttcacatgcatggagggctggaaggacttaccagccacctcatgccttctccagcaccagggccctcaaagcgagtggaagccatacagggacacagaggacagagaagcctttcagactggacaaaatgattacaaatgtagtgaatgtgggaaaaccttcacctgcagctattcatttgttgagcaccagaaaatccacacaggagaaaggtcttatgaatgtaacaaatgtgggaaattctttaagtacagtgccaatttcatgaaacatcagacagttcacactagtgaaaggacttatgagtgcagagaatgtggaaaatcctttatgtacaactaccgactcatgagacataagcgagttcacactggagaaaggccttatgagtgcaacacatgtgggaaattctttcggtacagctccacatttgttagacatcagagagttcacaccggagaaaggccgtatgagtgcagggaatgtgggaaattctttatggacagctccacactcattaaacatcagagagttcacaccggagaaagaccttataagtgcaatgattgtgggaaattttttaggtatatctccacactcattagacatcagagaattcacactggagaaaggccttatgagtgcagtgtatgtggggaattgtttaggtacaactccagccttgttaaacattggagaaatcacactggagaaaggccttataaatgcagtgaatgtgggaaatcatttaggtaccactgcaggctcattagacaccagagagtccacacgggagaaaggccttatgagtgcagcgaatgcgggaaattctttcgttacaactccaacctcattaaacattggagaaatcacactggagaaaggccttacgagtgcagagagtgtgggaaagcctttagccacaagcatatacttgttgagcaccagaaaatccacagtggagaaagaccttatgagtgcagcgaatgccagaaggcctttattagaaagtctcacctggttcatcaccagaaaatccacagtgaagagaggcttgtgtgctccatgaatgtggggaattctttagctaaaactccaacctcattaaacatcagagatttcacaatggagaaagtttaccattgactattgtaattgggtagtaatgttatataaattccacatttttatgcaactaatctccagaacatttttcctcttaccaagaagtaaaatgctgtacccattaacaacaactcattccccttccctacttccccagaaatgtctcaactatatttctatactctatggtacttatatgaggtaccaatagatatctatgaatttgatatatatttgtacctcatataagtggattctacagtatttatcttttgagactggcttatttcacttaggataaggtcttcacggttcacccatgttgtataatgtgtcagaatatccttcctttttaggtgaaataatattctatggtatttatataccacatttatttatccattcatctgttagtggatacttgggctacttccaccttttgcctattgaaataatgctgctatgaagatgagtgtacaagtgtctattcaagattctactttcaattcttatagggtatatactcagaaatggtggtgctggatcatataggatttctattttttttttttgtttgtttttgagacagagtcttgctctgtcacccaggctggagtgcagtgctgtgatcttggctcactgcaagctccgcctcccaggttcatgccattctcctgcctcaccctcccgagtagctgggactacaggtgcctgccaccacgcctggctaatttttttgtatttttagtagagacggggtttcaccgtgttagccaggatggtcctgatctcctgaccttgtgatctgcctgccttggcctctcaaagtgctgggattacgggcgtgagccaccgcgcctggccaggatttctatttttaatatttttgggaaaatttttccatagtacctgtgccattttacattcccaccagcagtgcacaaggattgcaatctatatacatcctcaccaacattgttcattttctatttctgtttttggggttttttgtagtgccttttgttttggatagcagctatcttgttggatgtgaggtggaatctatagtgtctttcatttttattttgtgaatgattgatgatgttgaggatcttttcatgtgcttgttaggcatttgtgtatctggaaaaatattcaagtcttttttttccatttttaatgggactatttgctttttgttgttgagttgtagttctttatacattctggatattaactccttaccaaatatatgctttttacatattacctcccagtccataggttgctttttcgctctgttgattgtgtcctttgatgaaattttaagttttgatgtactgttgactctttctgtctgtgggttctgtattcatggatcgaagcaaccatggatcaaaagtatttggagcatccatggattgcagtgatcattaatcaaaaatatttggaaaacaaaaagggtagttgcatctgtactaaacatgaacagacattttttcttgtcattattccctaaactatatagtataataaatatttacatagcatttacattgtattagaagttataaataacctaatgataatctatataggaagatgtgtgtaggttatattcaaacactatgcctttttatgtgagggacctcttgagcatcagatgattttggtatccacaaggggtcctggaatcagtcccccacagacaccaagggatgactgtagtgcattttatctatttttacttctgttacctgggcttttgatgttatatattaaaaaaaattagtatcaaatccaatgccaagcattttccctatgctttattctaagaattttatatttgaaggtcttacatttaggtcttttttttttttttcttttggaggcagagtcttgctctgtcacccagcctggagtgcagtagtggaatctcagctcactacaacctccgcctcctgggttcgagccatcaccccacctcagcctcccaagtagcttggattacaagtgtacaccaccacacctggctaatttttgtatttttagtagagatggggttttgccatgttggccaggctggtcttaaacttctggccttaagtgatccccctgcctcggcctcccaaattgctgagattacaggcaggagttgtaatgcactgtgcctggctacatttagatctttaatctacttggggttcatttttgcatatggtttaaggcaaaagtccactttatgtggctatccagttttccaagcaccattttttgaaaagagcatctttcctctgttgagtagtcttggcacacttgtcaaaatcatttgtccatatatgccatggtttatatgtggattctctattttattggtcatatgtctgtctttatgtcagtaccacacattttaggtgtgtgtgtgtgagactcagtgttgaggacaaggctagtgggctttcacactccagactgctgtattccagcccaaattactcaaattagccaatccatggggaacatggaaaacgtagctaatgcaatccgcttgccttacctaagttgtcccctgcagcctcaggttgctgttactgtgtttcagatgcaaccctctgtgggaccctacccaagttctctcattcttagctataggtaataaattgttctgattttgtgtatccaagtgacattgggttgtttcttgctatcagaagaacccagaaaagtattatgaatctagtgaatgttggaaaatctttagccattagcataacctcatttcgtgccagcatgttcaccctagagaaaagtagaagtgaaggcaatgtcatctttccttgttaacatgataactcagtagagcaatgctttggagattagctttttagggagagagccagcagttgagcctcctgcatctgaacatccacactagggatattgtctgtactgccagatatatgggaagattttgtgaactgtgttgcagttttcaacttgactggggcctttcccagagttatgcccctgccagtgcctatttaaaaatgtcatctcttttctaccaactggcaaagagccatggtgtgtagcattttagtcacattaaaatgcagttatggca

SEQ ID NO: 202892 - DNA, 569 bp, Homo sapiens
  Payload ID: 20013
  Gene Name: zinc finger protein 548
  ENST ID: ENST00000596282
  CDS Start-End: 398-569
gtggtggtcgttttggttctgtgtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgagagctgcagcactgaggcctgaggaactttattcaatgaattgagatcagtttgctcccaggcagggcagacgaggtggtggtccatctcagcctgaaggatccttccatggctgtcaatttctcacggcctttctcttccctcagggtcccctggcgatggcagaaatggaccctacacagggccgtgtggtctttgaggacgtggccatatatttctcccaggaggagtgggggcaccttgatgaggctcagagattgctgtaccgtgatgtgatgctggagaatttggcccttttgtcctcactaggttcttggcatggagctgagg

SEQ ID NO: 202893 - DNA, 571 bp, Homo sapiens
  Payload ID: 20013
  Gene Name: zinc finger protein 548
  ENST ID: ENST00000598895
  CDS Start-End: 217-480
gttttggttctgtgtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgagggtcccctggcgatggcagaaatggaccctacacagggccgtgtggtctttgaggacgtggccatatatttctcccaggaggagtgggggcaccttgatgaggctcagagattgctgtaccgtgatgtgatgctggagaatttggcccttttgtcctcactaggtaaggccctcacacttgcccagtgtcctgggttaggctgtgttacccctttttacccaaaggcagctctgcgtttcccacagtgagaccgtgggtgctgcttcttttccctgtttcttggcatatatgctgtgggaggcagggctgggccgtgtgttttataccccctttttccta

SEQ ID NO: 202894 - DNA, 563 bp, Homo sapiens
  Payload ID: 20013
  Gene Name: zinc finger protein 548
  ENST ID: ENST00000594668
  CDS Start-End: 337-563
agagttcgaagtttcaagttaggaaaaccaggttaggaatggacacagggagacgcgaaaaggccctgaggccactgcagtagacccaggagaattatggttggggctggaccagtgacagtagagggagatgtgatgagattcttcataggcctgaaagatagggcccgtaggttttcctggtgcttcagttatgtctgaacaaaggcagtgaagaaccgtttcaagtgtttgttttgttttttgttttctgtttgaacgtttggaagaatggagttggggaagtcagcataaagagcagatttccgggagaagatcacaggttggattttggacatggtgattctcaaatgtctcaagatggatatgtcacacagacaggtggacataaagggtcccctggcgatggcagaaatggaccctacacagggccgtgtggtctttgaggacgtggccatatatttctcccaggaggagtgggggcaccttgatgaggctcagagattgctgtaccgtgatgtgatgctggagaatttggcccttttgtcctcactaggttcttg

SEQ ID NO: 202895 - DNA, 535 bp, Homo sapiens
  Payload ID: 20013
  Gene Name: zinc finger protein 548
  ENST ID: ENST00000600442
  CDS Start-End: 96-266
gtcaactgacaagcgctggggacagtggcgtccttgtcttgcctttgtcgctcccgccccgctcttccctggctgggctggcggaggccttgctgatgaacctgactgagaatggagttggggaagtcagcataaagagcagatttccgggagaagatcacaggttggattttggacatggtgattctcaaatgtctcaagatggatatgtcacacagacaggtggacataaaggtgggctctgtgttgagagaacagggggctgagacttgggggccagaccattggtggctccacagacatcatactctgtccagaacggtgcagacctggcataacagggattctggattgcatctgtaaaaagggaggcctggactggggtcccctggcgatggcagaaatggaccctacacagggccgtgtggtctttgaggacgtggccatatatttctcccaggaggagtgggggcaccttgatgaggctcagagattgctgtaccgtgatgtgatgctggagaatttggcccttttg

SEQ ID NO: 202896 - DNA, 616 bp, Homo sapiens
  Payload ID: 20013
  Gene Name: zinc finger protein 548
  ENST ID: ENST00000600927
  CDS Start-End: 274-616
aagagcagatttccgggagaagatcacaggttggattttggacatggtgattctcaaatgtctcaagatggatatgtcacacagacaggtggacataaaggttgtcatttcaggtgggctctgtgttgagagaacagggggctgagacttgggggccagaccattggtggctccacagacatcatactctgtccagaacggtgcagacctggcataacagggattctggattgcatctgtaaaaagggaggcctggactggggtcccctggcgatggcagaaatggaccctacacagggccgtgtggtctttgaggacgtggccatatatttctcccaggaggagtgggggcaccttgatgaggctcagagattgctgtaccgtgatgtgatgctggagaatttggcccttttgtcctcactaggttcttggcatggagctgaggatgaggaggcaccttcacagcaaggtttttctgtaggagtgtcagaggttacagcttcaaagccctgtctgtccagccagaaggtccaccctagtgagacatgtggcccacccttgaaagacattctgtgcctggttgagcacaatggaattcatcctgagcaacacatat

SEQ ID NO: 202897 - DNA, 682 bp, Homo sapiens
  Payload ID: 20013
  Gene Name: zinc finger protein 548
  ENST ID: ENST00000597047
  CDS Start-End: 96-287
gtcaactgacaagcgctggggacagtggcgtccttgtcttgcctttgtcgctcccgccccgctcttccctggctgggctggcggaggccttgctgatgaacctgactgagaatggagttggggaagtcagcataaagagcagatttccgggagaagatcacaggttggattttggacatggtgattctcaaatgtctcaagatggatatgtcacacagacaggtggacataaagggtcccctggcgatggcagaaatggaccctacacagggccgtgtggtctttgaggacgtggccatatatttctcccaggaggagtgggggcaccttgatgaggctcagagattgctgtaccgtgatgtgatgctggagaatttggcccttttgtcctcactaggttcttggcatggagctgaggatgaggaggcaccttcacagcaaggtttttctgtaggagtgtcagaggttacagcttcaaagccctgtctgtccagccagaaggtccaccctagtgagacatgtggcccacccttgaaagacattctgtgcctggttgagcacaatggaattcatcctgagcaacacatatatatttgtgaggcagagctttttcagcacccaaagcagcaaattggagaaaatctttccagaggggatgattggataccttcatttgggaaga

SEQ ID NO: 202898 - DNA, 567 bp, Homo sapiens
  Payload ID: 20013
  Gene Name: zinc finger protein 548
  ENST ID: ENST00000602086
  CDS Start-End: 136-279
gagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgaggtgggctctgtgttgagagaacagggggctgagacttgggggccagaccattggtggctccacagacatcatactctgtccagaacggtgcagacctggcataacagggattctggattgcatctgtaaaaagggaggcctggactggggtcccctggcgatggcagaaatggaccctacacagggccgtgtggtctttgaggacgtggccatatatttctcccaggaggagtgggggcaccttgatgaggctcagagattgctgtaccgtgatgtgatgctggagaatttggcccttttgtcctcactaggttcttggcatggagctgaggatgaggaggcaccttcacagcaaggtttttctgtaggagtgtcagaggttacagcttcaaagccctgtctgtccagccagaaggt

SEQ ID NO: 202899 - DNA, 552 bp, Homo sapiens
  Payload ID: 20013
  Gene Name: zinc finger protein 548
  ENST ID: ENST00000594693
  CDS Start-End: 419-552
aggttcagagcatggaggcgctgccgagtgggctgtgttggggcgtcaggggtgtgtgttgtttctgcgggaaagagagggttttgtgaattctcgcttggaatggcaacctgagcagccagtaaccatggaagaatggagttggggaagtcagcataaagagcagatttccgggagaagatcacaggttggattttggacatggtgattctcaaatgtctcaagatggatatgtcacacagacaggtggacataaaggtgggctctgtgttgagagaacagggggctgagacttgggggccagaccattggtggctccacagacatcatactctgtccagaacggtgcagacctggcataacagggattctggattgcatctgtaaaaagggaggcctggactggggtcccctggcgatggcagaaatggaccctacacagggccgtgtggtctttgaggacgtggccatatatttctcccaggaggagtgggggcaccttgatgaggctcagagattgctgtaccgtgatgtgatgctggagaatttggc

SEQ ID NO: 202900 - DNA, 589 bp, Homo sapiens
  Payload ID: 20013
  Gene Name: zinc finger protein 548
  ENST ID: ENST00000597400
  CDS Start-End: 226-417
gtggtggtcgttttggttctgtgtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgagggtcccctggcgatggcagaaatggaccctacacagggccgtgtggtctttgaggacgtggccatatatttctcccaggaggagtgggggcaccttgatgaggctcagagattgctgtaccgtgatgtgatgctggagaatttggcccttttgtcctcactagcatttctgttctgacaggttcttggcatggagctgaggatgaggaggcaccttcacagcaaggtttttctgtaggagtgtcagaggttacagcttcaaagccctgtctgtccagccagaaggtccaccctagtgagacatgtggcccacccttgaaagacattctgtgcctggttgagcacaatgg

SEQ ID NO: 202901 - DNA, 3969 bp, Homo sapiens
  Payload ID: 20014
  Gene Name: zinc finger protein 549
  Uniprot ID: Q6P9A3
  ENST ID: ENST00000240719
  CDS Start-End: 250-2133
agaatcttccggcgtctttccggtggtggtcgtttttgctgcctgcgagcgcgtccgcgggctgggcgtttccggctcgctgggtccgggccaggtaactggagccggaaaccggtggaggtggtgtccgcccgcagaggagcttgcctggtctcggtctgagcgtcgcccagcgatttgccaccgcacgcacgccggatcccgggctttaccgcccgcctttccaggccccgccccgcctaaagtcccatggccgaggcagcgctagtgattacgccgcagggccatgtgacctttgaggatattgctgtgtacttctcccaggaggagtggggcctccttgatgaagctcaaaggtgcctgtatcatgatgtgatgctggagaacttttcgcttatggcctcagtaggttgtttgcatggaatagaggctgaggaggccccttctgagcagactctttctgcgcaaggagtgtcacaggccaggactccaaagctaggtccttccatcccaaatgctcattcttgtgagatgtgtatcctggtcatgaaagacattttgtacctcagtgagcatcaggggacacttccctggcagaaaccttatacgtctgtggccagtgggaaatggttttcatttggttctaacctgcaacagcaccagaaccaggacagtggagagaaacacatcagaaaggaggagagcagtgccttgcttctgaatagctgcaaaattcctctgtcagacaatcttttcccatgcaaagatgttgagaaggattttccaaccatcctgggccttctccaacaccagaccacccacagcagacaagagtatgcacatagaagcagggagacctttcaacaaagacgttacaaatgtgagcaagttttcaatgagaaagttcatgttactgagcatcagagagtccacactggagaaaaagcttataagcgtagggaatatgggaaatccttgaactctaaatacttatttgttgaacaccagagaacccataatgcagaaaagccttatgtgtgcaatatatgtgggaaatcattcctccataaacaaacactcgttgggcaccagcagagaattcacactagagaaaggtcttatgtgtgcatcgaatgtgggaaatccttgagctccaaatactcacttgtggaacaccagagaacccataatggagaaaagccttatgtgtgcaatgtatgtgggaaatcattccgccacaaacaaacatttgttggccatcagcagagaatccacactggagagaggccttatgtgtgtatggaatgtgggaaatcttttattcattcctatgaccgcattcgacaccagagagttcacactggagaaggggcttatcagtgcagtgaatgtgggaaatccttcatatacaaacagtcacttcttgatcaccatagaatccacacgggagaaaggccttatgagtgcaaagaatgtgggaaggccttcattcacaaaaaaagacttcttgagcaccagagaattcatactggagaaaagccttatgtgtgcatcatatgtgggaaatcatttatccgctcgtctgactacatgcgacaccagagaattcacactggagaaagggcttatgaatgcagtgactgtgggaaagccttcatctccaaacaaacacttcttaagcatcacaaaatccacactagagaaaggccttatgaatgcagtgaatgtggaaaaggcttctaccttgaggttaaacttcttcagcaccaaagaatccatactagagaacaactttgtgagtgcaatgaatgtggaaaagtcttcagccaccaaaaaagacttcttgagcaccagaaagttcacactggcgaaaagccctgtgagtgcagtgaatgtgggaaatgctttagacaccgcaccagcctcattcaacaccagaaagttcacagtggagagaggccttataactgcactgcatgtgagaaggcctttatctataaaaacaaacttgttgagcatcagcgaatccacaccggagaaaagccgtatgaatgtggtaaatgtgggaaagccttcaacaaaagatattcccttgtcaggcaccagaaggtacatataacagaagagccctagcaattgttgggatgtgtaattgtcttattcactgtaggacaccagagagctgatttttcaagggatccaacagacagaaattcaccctcatacatctgcatatcactagttgaaagattcactacaaggtccaagtacttgggaagctttctagagattacttgtactttctaatctgcccagtgttacaacagacactaccatgtggcatatcctcaccgttttcatcagtcactcacatgtgctcaaggaatgcagaccactgtgcttaccaaattctgaagggaataatataataaaagcctgttgagggtcctcttccatcttgctgaactgttcgaggcaaagacaaaacccaactttgaccaagaagagcaatctggattcttgtagcccatggaggtttaccttcttcataggttttttttttttttatgtgattgccatagtgggatattccctctcccacattacccaagagggaaatgggctgtcttaccatgtgctgatgtatgtgctctgccagtgtgaagggtgaacagctccaactttatgtccccccagggacatagtatgagatcggaaaatagttcttagtcctgtttgtcttaatttttattggtttccaaggtctcctaggaaggagagcagagctgtgtggtcctaatcatggtgtcgatgccagatttatttgtaggtccagaggtctccctgagaagaggcatttgtgacaaactcaagtgctgggacctgcatgaattgtttatttgcagtgatgcttcatatttcccagcactgttcatggtatcttatttcccaggtccttcattgtagccatgggcactgaaggactgaattggtaggtaggtcactggttgtaagacctactggggccaggtaagaacagtaattggcccagacaggtaggtgtgataaacagagtagaaaagattgtggccaagaagagtgaatgtgtcccatccaaaggtgcatccagatatgtctgtgttactatggcttcatggtttgggggtatatagaaattctcaggacctcagacctttgattctcctttagcaacacacatcgtcagcataaggcatctaaagattttgtggactcataacttatgtactgtttttgagatgattgctgcacgggcaggaaagcaggatttgagagaacatacaccttgccttccagatatgtggtttttgtgattcacccagatctgttgtgccagttaggaattatctttattacttcccgtttattgccactgctgagaaggctgtccttcctaacttgtgaggagatgaatccttaataataagtaaatcttgtgttatcctatagtctggttttccaaaaggagaggtagatgcatatttttgtgtggaaccatttatcttaaaacattgaggtgcagttttcatacacaaaaccttctatctttttaagaactgtctgtatggtttattgcccagttaatgggttttgatagtcatgttatctcagtaagtgtcttgtcttagaaatatgtgtgtataggctgggtgcggtggctcatgcctgtaatcccagcactttgggaggccaaggcaggtggatcacctgaggtcaggagtttgagaccagcctgaccaacatggtgaaatccagtctctacttaaaatacaaaaattagccaggcgtggtggcgtgcatttgtaatcccagctacacaggaggctgaggcaggagaattgcttgaacctggggggcggaggttgcaatgagccaaggtcgcgccattgcactccagcctgggcgacagagtgacacttctcaaaaaac

SEQ ID NO: 202902 - DNA, 4053 bp, Homo sapiens
  Payload ID: 20014
  Gene Name: zinc finger protein 549
  Uniprot ID: Q6P9A3
  ENST ID: ENST00000376233
  CDS Start-End: 182-2104
tttccggctcgctgggtccgggccaggtaactggagccggaaaccggtggaggtggtgtccgcccgcagaggagcttgcctggtctcggtctgagcgtcgcccagcgatttgccaccgcacgcacgccggatcccgggctttaccgcccgcctttccaggccccgccccgcctaaagtcccatggccgaggcagcgctagtgattacgccgcagattcccatggtaacagaagagtttgtgaaaccatcacagggccatgtgacctttgaggatattgctgtgtacttctcccaggaggagtggggcctccttgatgaagctcaaaggtgcctgtatcatgatgtgatgctggagaacttttcgcttatggcctcagtaggttgtttgcatggaatagaggctgaggaggccccttctgagcagactctttctgcgcaaggagtgtcacaggccaggactccaaagctaggtccttccatcccaaatgctcattcttgtgagatgtgtatcctggtcatgaaagacattttgtacctcagtgagcatcaggggacacttccctggcagaaaccttatacgtctgtggccagtgggaaatggttttcatttggttctaacctgcaacagcaccagaaccaggacagtggagagaaacacatcagaaaggaggagagcagtgccttgcttctgaatagctgcaaaattcctctgtcagacaatcttttcccatgcaaagatgttgagaaggattttccaaccatcctgggccttctccaacaccagaccacccacagcagacaagagtatgcacatagaagcagggagacctttcaacaaagacgttacaaatgtgagcaagttttcaatgagaaagttcatgttactgagcatcagagagtccacactggagaaaaagcttataagcgtagggaatatgggaaatccttgaactctaaatacttatttgttgaacaccagagaacccataatgcagaaaagccttatgtgtgcaatatatgtgggaaatcattcctccataaacaaacactcgttgggcaccagcagagaattcacactagagaaaggtcttatgtgtgcatcgaatgtgggaaatccttgagctccaaatactcacttgtggaacaccagagaacccataatggagaaaagccttatgtgtgcaatgtatgtgggaaatcattccgccacaaacaaacatttgttggccatcagcagagaatccacactggagagaggccttatgtgtgtatggaatgtgggaaatcttttattcattcctatgaccgcattcgacaccagagagttcacactggagaaggggcttatcagtgcagtgaatgtgggaaatccttcatatacaaacagtcacttcttgatcaccatagaatccacacgggagaaaggccttatgagtgcaaagaatgtgggaaggccttcattcacaaaaaaagacttcttgagcaccagagaattcatactggagaaaagccttatgtgtgcatcatatgtgggaaatcatttatccgctcgtctgactacatgcgacaccagagaattcacactggagaaagggcttatgaatgcagtgactgtgggaaagccttcatctccaaacaaacacttcttaagcatcacaaaatccacactagagaaaggccttatgaatgcagtgaatgtggaaaaggcttctaccttgaggttaaacttcttcagcaccaaagaatccatactagagaacaactttgtgagtgcaatgaatgtggaaaagtcttcagccaccaaaaaagacttcttgagcaccagaaagttcacactggcgaaaagccctgtgagtgcagtgaatgtgggaaatgctttagacaccgcaccagcctcattcaacaccagaaagttcacagtggagagaggccttataactgcactgcatgtgagaaggcctttatctataaaaacaaacttgttgagcatcagcgaatccacaccggagaaaagccgtatgaatgtggtaaatgtgggaaagccttcaacaaaagatattcccttgtcaggcaccagaaggtacatataacagaagagccctagcaattgttgggatgtgtaattgtcttattcactgtaggacaccagagagctgatttttcaagggatccaacagacagaaattcaccctcatacatctgcatatcactagttgaaagattcactacaaggtccaagtacttgggaagctttctagagattacttgtactttctaatctgcccagtgttacaacagacactaccatgtggcatatcctcaccgttttcatcagtcactcacatgtgctcaaggaatgcagaccactgtgcttaccaaattctgaagggaataatataataaaagcctgttgagggtcctcttccatcttgctgaactgttcgaggcaaagacaaaacccaactttgaccaagaagagcaatctggattcttgtagcccatggaggtttaccttcttcataggttttttttttttttatgtgattgccatagtgggatattccctctcccacattacccaagagggaaatgggctgtcttaccatgtgctgatgtatgtgctctgccagtgtgaagggtgaacagctccaactttatgtccccccagggacatagtatgagatcggaaaatagttcttagtcctgtttgtcttaatttttattggtttccaaggtctcctaggaaggagagcagagctgtgtggtcctaatcatggtgtcgatgccagatttatttgtaggtccagaggtctccctgagaagaggcatttgtgacaaactcaagtgctgggacctgcatgaattgtttatttgcagtgatgcttcatatttcccagcactgttcatggtatcttatttcccaggtccttcattgtagccatgggcactgaaggactgaattggtaggtaggtcactggttgtaagacctactggggccaggtaagaacagtaattggcccagacaggtaggtgtgataaacagagtagaaaagattgtggccaagaagagtgaatgtgtcccatccaaaggtgcatccagatatgtctgtgttactatggcttcatggtttgggggtatatagaaattctcaggacctcagacctttgattctcctttagcaacacacatcgtcagcataaggcatctaaagattttgtggactcataacttatgtactgtttttgagatgattgctgcacgggcaggaaagcaggatttgagagaacatacaccttgccttccagatatgtggtttttgtgattcacccagatctgttgtgccagttaggaattatctttattacttcccgtttattgccactgctgagaaggctgtccttcctaacttgtgaggagatgaatccttaataataagtaaatcttgtgttatcctatagtctggttttccaaaaggagaggtagatgcatatttttgtgtggaaccatttatcttaaaacattgaggtgcagttttcatacacaaaaccttctatctttttaagaactgtctgtatggtttattgcccagttaatgggttttgatagtcatgttatctcagtaagtgtcttgtcttagaaatatgtgtgtataggctgggtgcggtggctcatgcctgtaatcccagcactttgggaggccaaggcaggtggatcacctgaggtcaggagtttgagaccagcctgaccaacatggtgaaatccagtctctacttaaaatacaaaaattagccaggcgtggtggcgtgcatttgtaatcccagctacacaggaggctgaggcaggagaattgcttgaacctggggggcggaggttgcaatgagccaaggtcgcgccattgcactccagcctgggcgacagagtgacacttctcaaaaaacaaaaacaaaaacaaaaagaacagataagaaatacgtgtgtatatattctattttgtgtgttttcattcaccttatttcattcagtcttccaaatgaaatgttcttaattttga

SEQ ID NO: 202903 - DNA, 5505 bp, Homo sapiens
  Payload ID: 20014
  Gene Name: zinc finger protein 549
  ENST ID: ENST00000602149
  CDS Start-End: 149-463
gagccggaaaccggtggaggtggtgtccgcccgcagaggagcttgcctggtctcggtctgagcgtcgcccagcgatttgccaccgcacgcacgccggatcccgggctttaccgcccgcctttccaggccccgccccgcctaaagtcccatggccgaggcagcgctagtgattacgccgcagattcccatggtaacagaagagtttgtgaaaccatcacagggccatgtgacctttgaggatattgctgtgtacttctcccaggaggagtggggcctccttgatgaagctcaaaggtgcctgtatcatgatgtgatgctggagaacttttcgcttatggcctcagtagctggattgagccagagcaaccataaagattcctgttcacagcaaaaggtacctgtgtctctgaataattgtgtggctcagtgctcacctgatgatggacactatgacccaaagtgagtcagaaacaaccaggcccccggaaagccacaatgagcagtttcacacagaaattcagaggcagtggtgccctcacattatctgaagactgccatgactccacatgaccagctggtggctgcttacctgcacaggtagcatgtgagaggcctctcttcactatccacagctcctgcccatgctctagcaggtggaccaactctggtttgggaacccgatgccctgttgatagcaaaagaaatagaataggggtaatttaatgagaaaatgaaagtctctccatcttgcctaggacttcatgacagggtccagacatgaatgcagctgctcccaaagtaagcaaaatgctgatgtgagccctgaaaatcaagggcattgctctgagtgagctgtgttccccataaaaatcatatgttgatgccctaacacccaacgtgactgtatatggagacaggatctttagaaggtaattaaaattaaatgaggccacaagggtggagccttaatctgataaaattatggcctcataaaaacagagagagatctctcctctgtccctccaccttgtaagaacacagcaagtcagccatctgcaagccaggaagagaggtctcaataggaatcaaatttgccgacaccttgatcttggacttctcagcctccagaagcataagaaaataaactctcgttgtttaaaccacccaatccatgacattttattatggcagccaaggagataaaagacaggcacaaatcccactgttgggctacaactgccatggagggtagtgctatctgtctacacaacacccactgcccatgacctccgtctatggaagccaacgttgttcaggcacacaacactttgacagccatgggacacggcaaaggtgtgctgcttcctccagaaggcattttctttctttctttctttctttttttgaaacagagtctcactctgttgcccaggctggagtgcagtgctcggctcactgcaacctctgcctcccaggttcaagggattctcgtgcctcagccacccgagtagcagggattacaggcatgcaaaaccatgcctggctagtttttgtatttttaatagagactgggattcacaatattggtcaggctggtctcgagtgcctggcctcaagtgatcctcctgcctcagtctcccaaggtgctactgcacccggccccaggaggcattttctaacaaatctaaatcattgcttctcaaacacctcgtgctttcagaaccacttggggatgcgtgattccaacctcaaaccaaatgaaacaaaatttcttcgtgtgagacctgggcatcagtacttccaaaatgtgccccccaaaattctggtgcccagatggggctgcaaaccactggctgaggctggacatggtggctcatgctgtaatcccagcactataggaggccgaggcaggaggatcacttgaggccaggagttctaaaccagcctggccaacatggtgaaaccccgtctctaccaaaaatataaaaaattagccaggtatggtggtgtgcacctatggtcctagctactcaaggggatgaggttgggaggattgcttgagcctaggaagcagaggctgcagtgagctgagatcatggcactgcacttcagcctgaatgacagagcaagactccatctcaaaaaaaaaggaaaagaaaaaccagtggttgaaataaattggtaatgcaagagtcttcattaggcaggtgaccaaagctggattctcattgtgaaaagaaagcatttattccaaggtgggaggatggattgaacatgggggcctgctgccccagtcaaggctgcagcacccagcatccctatgaggagccagcctgaggacaatcagaagcctgaaccaagaagaaggaacagagaaccaagacatccttgatggcgtcactgggctgcggcaccgaacaagcctggagccaaccacacctcaggcttctcatcaggcgagttagtgaatttccttccaggtgaagccagtttgatctggttttctgttatatgcagccaaatgctttccactagatgtggtgagtaaaagacaggaggattctgtatagaagaccaatgactgaggtacaaggatccacagaaacatcgactggcagattctgaaccatagcccaggattccttcagacatgtcacagtaaggtccaccaatgtgtgctacatgcctggctttgagttctgggacagggctgtgggaaaggtgaatcagatgatcctttggctctcccaagagctgagctccctgtcacttttcacacgctggttcctccacctggaacactgttaccctcttccacctccttctatccagctaactcctactcagctttcaggtctcagctccactgtcacttcctgagatgccctctttggaactcccacaataggttatgacatcctgcttatttattcctaaattcccctcatttttctttctagaacttatttcagttgtcatctatggattgatgtccaccttcccaactgaactcagagtgtgccatcaattctaataacttctttatcctgacccacttttgttaaatattgtattctaaaagggaaccttgttttgctctggtaagtgagaaagtcaatttcccttcctacaaatagaagtctgcaatcacaacacaacaaaatcaaaacaatgccactaagtcccaggaaacccttgtatgtttcttagggctaagttggaggttgtcccctctgttaaaaaaaagaaatgaactgcactgggggagtgaaaggaaaatgaaagactcagcgctgatctgagacttttctttttttttgagccggagtcttgctcagtcacccaggctagaatgcactggcgcaatgttggctcactgcaacctccgcctcccaggttcaagcgattctcctgcttcaaactcctgagtagctgggattacaggcgcgcaccactgcgcccagctaatttttgtatttttagtacagacggggtttcaccatcttggccaggttggtattgaactcctgacctcgtgatccacccgcctcggcctcccaaagtgctgggattacaggcgtgagccaccacacccagctgatgagacttttatgacaagaattagcgtgctggacagagaaagtaaaaggaatggctttatcagggtatcaaaccatgccatttgaggacattcctgtgtaccctctaaaaacacctcctggatcaacagagcatggatatcaagcatcagaaaacaactaatgaccatgcaggcacccagatgcctttttacagagattgtattgcttaggaagatatccgaggggcactgaggacaaatgtcttctggggggctgcctgactcacccctttctctaagaacagcccatcacccatggcccctgcttaatagggctgtggccacagctgaccccaccaggatggccaatcagcttccttcttatgcaatcttgattaaggacctcagaatgggctgagcactggagtgagggtttgtgttaaaaggacattttctaccccgacaatctctgatgcagacaaagggagaccagtcaggaagaggtgggaacagaaaggtctgtcaagagaaaggtgggcagttccagtgacctttttgcctggccaagaatcagggttagggtcctcctcagggatgagaggtgagtcattacctagtgaaaccagaagcccacaggtctccagcatcacctctcggtacagggtcctctgggccaggtccagctgtctccactcctcccgggtaaaggtcacagccacatccttgaaggtcaccaacatctggaaagtcaaacagaagtaatgctattggccttgtgttgtcgcataggatcagaacctgtcactcagtctctagtcaatgtgcagagagatccaggtctgaatcaactaggtctcctttgggctgacttccgtgcagggctcaaaggggaggcagatactgccttttgacaatgcaattgtgcctgagagaaaagccttctatggggaagctgttgaagatgacacaaacaatggcaatcccacgaggactatgggaagcagagagtaagtactctggcatattaaaagaatggaggaaaatgactgatactaatccaaccacaataacagcaacagcagcagctaagtgtgggggaaagaaaaatagatcagaccgttactgtgtctatgtagaaaaaggaagacataagaaactccattttgatctgtactaagaaaaattcttctgccttgagatgctgttaatctgtaaccctagccccaaccctgtgctcacagaaacatgtgctgtattgactcaaggtttaatggagttagggctgtgcaggatgtgccttggtaaacatgtgtttgcaggcagtatgcttggtaaaagtcatcgccattctcccgtctcgggtacccagggacacaatgcactgcggaaggccacagggacctctgcccgagaaagcctgggtattgtccaaggtttccccccactgagacagcctgagatgtggcctcgtgggaagggaaagaccttaccttccctcagcccgacacccataaagggtctgtgctgacgaggattcatgaaagaggaaggcctctttgcagttgagataagaggaaggcatctgtctcctgcttgtccctgggaatggaatgtcttggtgtaaaacccgagcgtacattctatttactgagataggagaaagccgccttatggctggaggtaagacatgctggcggcaatactgctctttactgcactgagatgtttgggtaaagtcaaacataaatctggcctacgtgcacatcgaggcacagcacctttccttaaacttatttatgacacagagtcctttgctcacatgttttcctgctgaccctctccccactcattaccctatagtcctgccacatccccctcatggagatggtagagatagtgatcaataaatactgagagaactcaga

SEQ ID NO: 202904 - DNA, 556 bp, Homo sapiens
  Payload ID: 20014
  Gene Name: zinc finger protein 549
  ENST ID: ENST00000594943
  CDS Start-End: 154-195
aactggagccggaaaccggtggaggtggtgtccgcccgcagaggagcttgcctggtctcggtctgagcgtcgcccagcgatttgccaccgcacgcacgccggatcccgggctttaccgcccgcctttccaggccccgccccgcctaaagtcccatggccgaggcagcgctagtgattacgccgcagctggattgagccagagcaaccataaagattcctgttcacagcaaaaggtacctgtgtctctgaataattgtgtggctcagtgctcacctgatgatggacactatgacccaaagtgagtcagaaacaaccaggcccccggaaagccacaatgagcagtttcacacagaaattcagaggcagtggtgccctcacattatctgaagactgccatgactccacatgaccagctggtggctgcttacctgcacaggtagcatgtgagaggcctctcttcactatccacagctcctgcccatgctctagcaggtggaccaactctggtttgggaacccgatgccctgttgatagcaaaagaaatagaataggggta

SEQ ID NO: 202905 - DNA, 1361 bp, Homo sapiens
  Payload ID: 20015
  Gene Name: zinc finger protein 550
  ENST ID: ENST00000506609
  CDS Start-End: 4-1149
cagatgttggtgaccttcaaggatgtggctgtgacctttacccgggaggagtggagacagctggacctggcccagaggaccctgtaccgagaggtgatgctggagacctgtgggcttctggtttcactaggtgacagagcacaagttcataccagagagccaaccacttacccgccagtcttatctgagcgggcctttctccggggaagcctgactctggaatcttcaacctcaagtgattcgaggttggggagagctagggatgaggaagggcttttggaaatgcagaaaggtaaagtgacaccggagacagacctccacaaggagacccatcttgggaaagtgagccttgaaggtgaaggtttggggacagatgatggtctgcactccagggcattacaagagtggttatcagcagatgttctccatgaatgtgactcacagcaaccagggaaagacgccttgattcatgcagggacaaacccctacaaatgcaagcagtgtgggaaaggttttaacaggaagtggtatctcgttcgacatcagagggttcacactggaatgaaaccctatgaatgcaatgcatgtgggaaagcctttagccagagctcaactctcattcggcactacctcatccacaccggggagaaaccatacaagtgccttgagtgtgggaaggccttcaaacgcaggtcgtacctcatgcagcaccatccaatccacactggagagaaaccctatgagtgtagtcaatgtcgaaaggccttcacccaccggtctacttttattcgccataataggacccacactggagaaaagccctttgagtgcaaagaatgtgagaaagcctttagcaatagagcccacctaattcaacattacatcatccacactggagagaagccctatgattgcatggcatgtggaaaggccttcagatgcagctcagaactcatacagcaccagcggattcacactggggagaagccctatgaatgcacccagtgtgggaaagcctttcaccggagcacgtacctcattcagcactctgtcatccacactggggagatgccctacaagtgtatcgagtgtgggaaggccttcaaacgcaggtcacaccttctgcagcaccaaagggtccatacatgagagaaccctattgctgcaatgaatacagcaaggcctttacccactgttattttatcattcataatgggacccacactgtaggaagaagtccttcgaatgcaaagaatgtcaggaaacttttcattttttttgtcagctctttcttaactaacacatgagcagtcactttggagagaagccctgtgaatacagtgaatgtaaggatcccttca

SEQ ID NO: 202906 - DNA, 3485 bp, Homo sapiens
  Payload ID: 20015
  Gene Name: zinc finger protein 550
  ENST ID: ENST00000344222
  CDS Start-End: 1-1019
gtgacagagcacaagttcataccagagagccaaccacttacccgccagtcttatctgagcgggcctttctccggggaagcctgactctggaatcttcaacctcaagtgattcgaggttggggagagctagggatgaggaagggcttttggaaatgcagaaaggtaaagtgacaccggagacagacctccacaaggagacccatcttgggaaagtgagccttgaaggtgaaggtttggggacagatgatggtctgcactccagggcattacaagagtggttatcagcagatgttctccatgaatgtgactcacagcaaccagggaaagacgccttgattcatgcagggacaaacccctacaaatgcaagcagtgtgggaaaggttttaacaggaagtggtatctcgttcgacatcagagggttcacactggaatgaaaccctatgaatgcaatgcatgtgggaaagcctttagccagagctcaactctcattcggcactacctcatccacaccggggagaaaccatacaagtgccttgagtgtgggaaggccttcaaacgcaggtcgtacctcatgcagcaccatccaatccacactggagagaaaccctatgagtgtagtcaatgtcgaaaggccttcacccaccggtctacttttattcgccataataggacccacactggagaaaagccctttgagtgcaaagaatgtgagaaagcctttagcaatagagcccacctaattcaacattacatcatccacactggagagaagccctatgattgcatggcatgtggaaaggccttcagatgcagctcagaactcatacagcaccagcggattcacactggggagaagccctatgaatgcacccagtgtgggaaagcctttcaccggagcacgtacctcattcagcactctgtcatccacactggggagatgccctacaagtgtatcgagtgtgggaaggccttcaaacgcaggtcacaccttctgcagcaccaaagggtccatacatgagagaaccctattgctgcaatgaatacagcaaggcctttacccactgttattttatcattcataatgggacccacactgtaggaagaagtccttcgaatgcaaagaatgtcaggaaacttttcattttttttgtcagctctttcttaactaacacatgagcagtcactttggagagaagccctgtgaatacagtgaatgtaaggatcccttcagtcaccactcagttctcactcattgcagaaggattcataccagggggaaatgtggaaggcattccatcaacatcagagaactcatgctggagaaagacattccaaatataactattaaggacagtctttggccagagcagaaatcttactatctgagaatcataatgaaaagttactacataattgttattgatgtgagaaaactttgtgaccaggttgtcacttgcttgtcctataaagagccatgctggaatttgacccaccttgggattttctctatgaacttatgaaaaccttcagttacaggacagagtgcacagtttcctctcctgtgggaaggagagttgactcttgaggacccccaccctcctgcatcctctctctggaaggctgcatgtattgtagctgtggctgtacttgtacctaaggccctgggttcaagagagttggagaaacccctctagaaacatattggctgtcatcaaagggttctttccaggcctgaggacctaggccccagtttgtcccaaagcaggagtgttttccatgggataaaggacaccctaggtttttcttagcttccagctctttccatacagtcttcactgaagtgtttggtacaaggatctactatgaacttgctgctgtgataggcaagaatctcatgagacacctgtcatttagctccatggccactcactgttgtggtcatacttagaagagtgggatgcagtggatggctgggctatgggtcctgcccttgagcagggaaggaacttactgtctaatataggaaaaacacatgagaacaggtgcaatatattgacttaaacttgtttagcacccgtttttaagtcagtagaagttttgaacttacagtaaaagttgtgaacttctgtatgttttccacagtttatgattgaggtaaaacatgttttttgttttgtttttgagacagagtttcactcttgttgcccaggctggagtgcagtggcgccatctcagctcactgcaacttctgcctcccgagttcaagggattctcctgcctcagcctcccgagtagctgggattacaggcgcccaccaccatgcccggctagtttttttgtatttttagtagagacggggtttcaccatgttggccaggctggtcttgaactcttgacctcatgtagtccacccgcctctgcctcccaaagtgctgcgattacaggcgtgagccaccgtgcccggcagaggtaaaacgttttcatgttcatgtttttgtaactttgttacatttaatgaacaaattagataaaaagcactatgctcttatgctgcttaatctgtgagaaatgattgtgggggtgggactagttatgaccattcacagttggtgcacttcaatcagtaaatgtcacagaggaaatgtggacggtaaattaactcggcaagtcggtcatgcaaagacgaattagaaatcttaatatttgtaagcagacaaaaaatgtgtctggaaggatcctcacccagttaaatggtatttgctccttgggtgtagagggagggaagggatggggtagaggggaatgtcagagttcactttaacttcatgcacatgtggaaatgtttgaaatgttcacagtaaattttataatttcagaaaaactgcttaaggttgaaaagagaaatttaagaaattgctgacggaataaaaacataatagaactacaacaccgaaggaaatgaaagaagcaagaaggaaagcaccagaagtgatttggaagagaaatcctaaaatgaatgtgaacaacagagtgatcagaagagtgtagggaattaatagtttctttaaacaagccatctcacaatggaagcctgtgtgtcttgaaattgctgtggttattattcactctgccctttgaagaactgcagaaattcatagggcaatgttaagtgtttgtgtctccaaaaaagatgttggagtcgttaccctcagaacctcaggtaatcatgttagttaatccattaggttagttcctaattgactatgactgtgtccttagaaaaatgggaaatttggtcacagaggcagatgtacagagggaagacgatgtgaagacacaggaagaacatcttcaagccaaggaacacacggggctaccagaagccgagatagaagcatggaacatatgttctagtaagaagtgtctgggttgttttggttttttttctttggagtttttgtggtattaaattatttttaaatta

SEQ ID NO: 202907 - DNA, 4305 bp, Homo sapiens
  Payload ID: 20015
  Gene Name: zinc finger protein 550
  Uniprot ID: Q7Z398
  ENST ID: ENST00000325134
  CDS Start-End: 182-1450
gggacttccggcctcgctggcgtggacgtttgtggtggggcgtgttggtccgcgctctcagaactgtgctgggaaggatggtagggcgactggggctcacctccgcaccgttgtaggacccggggtagggttttgagcccgtgggagctgccccacgcggcctcgtcctgccaacggtcggatggcggagacgaaggacgcagcgcagatgttggtgaccttcaaggatgtggctgtgacctttacccgggaggagtggagacagctggacctggcccagaggaccctgtaccgagaggtgatgctggagacctgtgggcttctggtttcactagggcatcgggttcccaaaccagagttggtccacctgctagagcatgggcaggagctgtggatagtgaagagaggcctctcacatgctacctgtgcaggtgacagagcacaagttcataccagagagccaaccacttacccgccagtcttatctgagcgggcctttctccggggaagcctgactctggaatcttcaacctcaagtgattcgaggttggggagagctagggatgaggaagggcttttggaaatgcagaaaggtaaagtgacaccggagacagacctccacaaggagacccatcttgggaaagtgagccttgaaggtgaaggtttggggacagatgatggtctgcactccagggcattacaagagtggttatcagcagatgttctccatgaatgtgactcacagcaaccagggaaagacgccttgattcatgcagggacaaacccctacaaatgcaagcagtgtgggaaaggttttaacaggaagtggtatctcgttcgacatcagagggttcacactggaatgaaaccctatgaatgcaatgcatgtgggaaagcctttagccagagctcaactctcattcggcactacctcatccacaccggggagaaaccatacaagtgccttgagtgtgggaaggccttcaaacgcaggtcgtacctcatgcagcaccatccaatccacactggagagaaaccctatgagtgtagtcaatgtcgaaaggccttcacccaccggtctacttttattcgccataataggacccacactggagaaaagccctttgagtgcaaagaatgtgagaaagcctttagcaatagagcccacctaattcaacattacatcatccacactggagagaagccctatgattgcatggcatgtggaaaggccttcagatgcagctcagaactcatacagcaccagcggattcacactggggagaagccctatgaatgcacccagtgtgggaaagcctttcaccggagcacgtacctcattcagcactctgtcatccacactggggagatgccctacaagtgtatcgagtgtgggaaggccttcaaacgcaggtcacaccttctgcagcaccaaagggtccatacatgagagaaccctattgctgcaatgaatacagcaaggcctttacccactgttattttatcattcataatgggacccacactgtaggaagaagtccttcgaatgcaaagaatgtcaggaaacttttcattttttttgtcagctctttcttaactaacacatgagcagtcactttggagagaagccctgtgaatacagtgaatgtaaggatcccttcagtcaccactcagttctcactcattgcagaaggattcataccagggggaaatgtggaaggcattccatcaacatcagagaactcatgctggagaaagacattccaaatataactattaaggacagtctttggccagagcagaaatcttactatctgagaatcataatgaaaagttactacataattgttattgatgtgagaaaactttgtgaccaggttgtcacttgcttgtcctataaagagccatgctggaatttgacccaccttgggattttctctatgaacttatgaaaaccttcagttacaggacagagtgcacagtttcctctcctgtgggaaggagagttgactcttgaggacccccaccctcctgcatcctctctctggaaggctgcatgtattgtagctgtggctgtacttgtacctaaggccctgggttcaagagagttggagaaacccctctagaaacatattggctgtcatcaaagggttctttccaggcctgaggacctaggccccagtttgtcccaaagcaggagtgttttccatgggataaaggacaccctaggtttttcttagcttccagctctttccatacagtcttcactgaagtgtttggtacaaggatctactatgaacttgctgctgtgataggcaagaatctcatgagacacctgtcatttagctccatggccactcactgttgtggtcatacttagaagagtgggatgcagtggatggctgggctatgggtcctgcccttgagcagggaaggaacttactgtctaatataggaaaaacacatgagaacaggtgcaatatattgacttaaacttgtttagcacccgtttttaagtcagtagaagttttgaacttacagtaaaagttgtgaacttctgtatgttttccacagtttatgattgaggtaaaacatgttttttgttttgtttttgagacagagtttcactcttgttgcccaggctggagtgcagtggcgccatctcagctcactgcaacttctgcctcccgagttcaagggattctcctgcctcagcctcccgagtagctgggattacaggcgcccaccaccatgcccggctagtttttttgtatttttagtagagacggggtttcaccatgttggccaggctggtcttgaactcttgacctcatgtagtccacccgcctctgcctcccaaagtgctgcgattacaggcgtgagccaccgtgcccggcagagaaaaactgcttaaggttgaaaagagaaatttaagaaattgctgacggaataaaaacataatagaactacaacaccgaaggaaatgaaagaagcaagaaggaaagcaccagaagtgatttggaagagaaatcctaaaatgaatgtgaacaacagagtgatcagaagagtgtagggaattaatagtttctttaaacaagccatctcacaatggaagcctgtgtgtcttgaaattgctgtggttattattcactctgccctttgaagaactgcagaaattcatagggcaatgttaagtgtttgtgtctccaaaaaagatgttggagtcgttaccctcagaacctcaggtaatcatgttagttaatccattaggttagttcctaattgactatgactgtgtccttagaaaaatgggaaatttggtcacagaggcagatgtacagagggaagacgatgtgaagacacaggaagaacatcttcaagccaaggaacacacggggctaccagaagccgagatagaagcatggaacatatgttctagtaagaagtgtctgggttgttttggttttttttctttggagtttttgtggtattaaattatttttaaattatgttttattgtagacctcacaattctttttttttctttttcactcaaactacagcaaaatattatatttctatcctatatttcatgggcttacctctagccaattgtttttaactgccatgtaatattttacatcatgaagctttcatccttgattcaaatcctctgattatggacatgtatttcctccattttcctgctatgaaatatatcaccaccagcttgattcaaccttaaaaataaggtcatcagtattatgttctaaataaacttatggccatacatgagaaatgtaccttgcagctgaatggctaggtcatatggtgatctagtatgtaactggaattatgttatacattgcccttcctctcccataagatggacaaaagtgtttctgtatcactgtgtcccagacaatatttagaattacccagctttccagtttttactttagaagtttaaagtgatatagaatatatctggtatttctcatattgaaatacatttgaacattagttcatatcctttcattgccttttgtttttcctcttctgtcaatggtctactcatatgttggcctgtctttatttgtatcttgactttttattgtgtattttgtttatggtggggtactttattggtgattaatacgattttcaagtatattatatgggctagtcccttgatactattgacactgtatttatcttcagtctcttgttggtatctaactttggttctgaagtttatggaatggaagtatttaattggaaagattaaacatattgattttaatt

SEQ ID NO: 202908 - DNA, 3719 bp, Homo sapiens
  Payload ID: 20015
  Gene Name: zinc finger protein 550
  Uniprot ID: Q7Z398
  ENST ID: ENST00000376230
  CDS Start-End: 182-1450
gggacttccggcctcgctggcgtggacgtttgtggtggggcgtgttggtccgcgctctcagaactgtgctgggaaggatggtagggcgactggggctcacctccgcaccgttgtaggacccggggtagggttttgagcccgtgggagctgccccacgcggcctcgtcctgccaacggtcggatggcggagacgaaggacgcagcgcagatgttggtgaccttcaaggatgtggctgtgacctttacccgggaggagtggagacagctggacctggcccagaggaccctgtaccgagaggtgatgctggagacctgtgggcttctggtttcactagggcatcgggttcccaaaccagagttggtccacctgctagagcatgggcaggagctgtggatagtgaagagaggcctctcacatgctacctgtgcaggtgacagagcacaagttcataccagagagccaaccacttacccgccagtcttatctgagcgggcctttctccggggaagcctgactctggaatcttcaacctcaagtgattcgaggttggggagagctagggatgaggaagggcttttggaaatgcagaaaggtaaagtgacaccggagacagacctccacaaggagacccatcttgggaaagtgagccttgaaggtgaaggtttggggacagatgatggtctgcactccagggcattacaagagtggttatcagcagatgttctccatgaatgtgactcacagcaaccagggaaagacgccttgattcatgcagggacaaacccctacaaatgcaagcagtgtgggaaaggttttaacaggaagtggtatctcgttcgacatcagagggttcacactggaatgaaaccctatgaatgcaatgcatgtgggaaagcctttagccagagctcaactctcattcggcactacctcatccacaccggggagaaaccatacaagtgccttgagtgtgggaaggccttcaaacgcaggtcgtacctcatgcagcaccatccaatccacactggagagaaaccctatgagtgtagtcaatgtcgaaaggccttcacccaccggtctacttttattcgccataataggacccacactggagaaaagccctttgagtgcaaagaatgtgagaaagcctttagcaatagagcccacctaattcaacattacatcatccacactggagagaagccctatgattgcatggcatgtggaaaggccttcagatgcagctcagaactcatacagcaccagcggattcacactggggagaagccctatgaatgcacccagtgtgggaaagcctttcaccggagcacgtacctcattcagcactctgtcatccacactggggagatgccctacaagtgtatcgagtgtgggaaggccttcaaacgcaggtcacaccttctgcagcaccaaagggtccatacatgagagaaccctattgctgcaatgaatacagcaaggcctttacccactgttattttatcattcataatgggacccacactgtaggaagaagtccttcgaatgcaaagaatgtcaggaaacttttcattttttttgtcagctctttcttaactaacacatgagcagtcactttggagagaagccctgtgaatacagtgaatgtaaggatcccttcagtcaccactcagttctcactcattgcagaaggattcataccagggggaaatgtggaaggcattccatcaacatcagagaactcatgctggagaaagacattccaaatataactattaaggacagtctttggccagagcagaaatcttactatctgagaatcataatgaaaagttactacataattgttattgatgtgagaaaactttgtgaccaggttgtcacttgcttgtcctataaagagccatgctggaatttgacccaccttgggattttctctatgaacttatgaaaaccttcagttacaggacagagtgcacagtttcctctcctgtgggaaggagagttgactcttgaggacccccaccctcctgcatcctctctctggaaggctgcatgtattgtagctgtggctgtacttgtacctaaggccctgggttcaagagagttggagaaacccctctagaaacatattggctgtcatcaaagggttctttccaggcctgaggacctaggccccagtttgtcccaaagcaggagtgttttccatgggataaaggacaccctaggtttttcttagcttccagctctttccatacagtcttcactgaagtgtttggtacaaggatctactatgaacttgctgctgtgatagaaaaactgcttaaggttgaaaagagaaatttaagaaattgctgacggaataaaaacataatagaactacaacaccgaaggaaatgaaagaagcaagaaggaaagcaccagaagtgatttggaagagaaatcctaaaatgaatgtgaacaacagagtgatcagaagagtgtagggaattaatagtttctttaaacaagccatctcacaatggaagcctgtgtgtcttgaaattgctgtggttattattcactctgccctttgaagaactgcagaaattcatagggcaatgttaagtgtttgtgtctccaaaaaagatgttggagtcgttaccctcagaacctcaggtaatcatgttagttaatccattaggttagttcctaattgactatgactgtgtccttagaaaaatgggaaatttggtcacagaggcagatgtacagagggaagacgatgtgaagacacaggaagaacatcttcaagccaaggaacacacggggctaccagaagccgagatagaagcatggaacatatgttctagtaagaagtgtctgggttgttttggttttttttctttggagtttttgtggtattaaattatttttaaattatgttttattgtagacctcacaattctttttttttctttttcactcaaactacagcaaaatattatatttctatcctatatttcatgggcttacctctagccaattgtttttaactgccatgtaatattttacatcatgaagctttcatccttgattcaaatcctctgattatggacatgtatttcctccattttcctgctatgaaatatatcaccaccagcttgattcaaccttaaaaataaggtcatcagtattatgttctaaataaacttatggccatacatgagaaatgtaccttgcagctgaatggctaggtcatatggtgatctagtatgtaactggaattatgttatacattgcccttcctctcccataagatggacaaaagtgtttctgtatcactgtgtcccagacaatatttagaattacccagctttccagtttttactttagaagtttaaagtgatatagaatatatctggtatttctcatattgaaatacatttgaacattagttcatatcctttcattgccttttgtttttcctcttctgtcaatggtctactcatatgttggcctgtctttatttgtatcttgactttttattgtgtattttgtttatggtggggtactttattggtgattaatacgattttcaagtatattatatgggctagtcccttgatactattgacactgtatttatcttcagtctcttgttggtatctaactttggttctgaagtttatggaatggaagtatttaattggaaagattaaacatattgattttaatt

SEQ ID NO: 202909 - DNA, 4305 bp, Homo sapiens; identical to SEQ ID NO: 202907
  Payload ID: 20015
  Gene Name: zinc finger protein 550
  Uniprot ID: Q7Z398
  ENST ID: ENST00000447310
  CDS Start-End: 182-1450

SEQ ID NO: 202910 - DNA, 3376 bp, Homo sapiens
  Payload ID: 20015
  Gene Name: zinc finger protein 550
  Uniprot ID: Q7Z398
  ENST ID: ENST00000457177
  CDS Start-End: 182-1450
gggacttccggcctcgctggcgtggacgtttgtggtggggcgtgttggtccgcgctctcagaactgtgctgggaaggatggtagggcgactggggctcacctccgcaccgttgtaggacccggggtagggttttgagcccgtgggagctgccccacgcggcctcgtcctgccaacggtcggatggcggagacgaaggacgcagcgcagatgttggtgaccttcaaggatgtggctgtgacctttacccgggaggagtggagacagctggacctggcccagaggaccctgtaccgagaggtgatgctggagacctgtgggcttctggtttcactagggcatcgggttcccaaaccagagttggtccacctgctagagcatgggcaggagctgtggatagtgaagagaggcctctcacatgctacctgtgcaggtgacagagcacaagttcataccagagagccaaccacttacccgccagtcttatctgagcgggcctttctccggggaagcctgactctggaatcttcaacctcaagtgattcgaggttggggagagctagggatgaggaagggcttttggaaatgcagaaaggtaaagtgacaccggagacagacctccacaaggagacccatcttgggaaagtgagccttgaaggtgaaggtttggggacagatgatggtctgcactccagggcattacaagagtggttatcagcagatgttctccatgaatgtgactcacagcaaccagggaaagacgccttgattcatgcagggacaaacccctacaaatgcaagcagtgtgggaaaggttttaacaggaagtggtatctcgttcgacatcagagggttcacactggaatgaaaccctatgaatgcaatgcatgtgggaaagcctttagccagagctcaactctcattcggcactacctcatccacaccggggagaaaccatacaagtgccttgagtgtgggaaggccttcaaacgcaggtcgtacctcatgcagcaccatccaatccacactggagagaaaccctatgagtgtagtcaatgtcgaaaggccttcacccaccggtctacttttattcgccataataggacccacactggagaaaagccctttgagtgcaaagaatgtgagaaagcctttagcaatagagcccacctaattcaacattacatcatccacactggagagaagccctatgattgcatggcatgtggaaaggccttcagatgcagctcagaactcatacagcaccagcggattcacactggggagaagccctatgaatgcacccagtgtgggaaagcctttcaccggagcacgtacctcattcagcactctgtcatccacactggggagatgccctacaagtgtatcgagtgtgggaaggccttcaaacgcaggtcacaccttctgcagcaccaaagggtccatacatgagagaaccctattgctgcaatgaatacagcaaggcctttacccactgttattttatcattcataatgggacccacactgtaggaagaagtccttcgaatgcaaagaatgtcaggaaacttttcattttttttgtcagctctttcttaactaacacatgagcagtcactttggagagaagccctgtgaatacagtgaatgtaaggatcccttcagtcaccactcagttctcactcattgcagaaggattcataccagggggaaatgtggaaggcattccatcaacatcagagaactcatgctggagaaagacattccaaatataactattaaggacagtctttggccagagcagaaatcttactatctgagaatcataatgaaaagttactacataattgttattgatgtgagaaaactttgtgaccaggttgtcacttgcttgtcctataaagagccatgctggaatttgacccaccttgggattttctctatgaacttatgaaaaccttcagttacagaaaaactgcttaaggttgaaaagagaaatttaagaaattgctgacggaataaaaacataatagaactacaacaccgaaggaaatgaaagaagcaagaaggaaagcaccagaagtgatttggaagagaaatcctaaaatgaatgtgaacaacagagtgatcagaagagtgtagggaattaatagtttctttaaacaagccatctcacaatggaagcctgtgtgtcttgaaattgctgtggttattattcactctgccctttgaagaactgcagaaattcatagggcaatgttaagtgtttgtgtctccaaaaaagatgttggagtcgttaccctcagaacctcaggtaatcatgttagttaatccattaggttagttcctaattgactatgactgtgtccttagaaaaatgggaaatttggtcacagaggcagatgtacagagggaagacgatgtgaagacacaggaagaacatcttcaagccaaggaacacacggggctaccagaagccgagatagaagcatggaacatatgttctagtaagaagtgtctgggttgttttggttttttttctttggagtttttgtggtattaaattatttttaaattatgttttattgtagacctcacaattctttttttttctttttcactcaaactacagcaaaatattatatttctatcctatatttcatgggcttacctctagccaattgtttttaactgccatgtaatattttacatcatgaagctttcatccttgattcaaatcctctgattatggacatgtatttcctccattttcctgctatgaaatatatcaccaccagcttgattcaaccttaaaaataaggtcatcagtattatgttctaaataaacttatggccatacatgagaaatgtaccttgcagctgaatggctaggtcatatggtgatctagtatgtaactggaattatgttatacattgcccttcctctcccataagatggacaaaagtgtttctgtatcactgtgtcccagacaatatttagaattacccagctttccagtttttactttagaagtttaaagtgatatagaatatatctggtatttctcatattgaaatacatttgaacattagttcatatcctttcattgccttttgtttttcctcttctgtcaatggtctactcatatgttggcctgtctttatttgtatcttgactttttattgtgtattttgtttatggtggggtactttattggtgattaatacgattttcaagtatattatatgggctagtcccttgatactattgacactgtatttatcttcagtctcttgttggtatctaactttggttctgaagtttatggaatggaagtatttaattggaaagattaaacatattgattttaattaata

SEQ ID NO: 202911 - DNA, 515 bp, Homo sapiens
  Payload ID: 20015
  Gene Name: zinc finger protein 550
  ENST ID: ENST00000601415
  CDS Start-End: 131-508
gcgctctcagaactgtgctgggaaggatggtagggcgactggggctcacctccgcaccgttgtaggacccggggtagggttttgagcccgtgggagctgccccacgcggcctcgtcctgccaacggtcggatggcggagacgaaggacgcagcgcagatgttggtgaccttcaaggatgtggctgtgacctttacccgggaggagtggagacagctggacctggcccagaggaccctgtaccgagaggtgatgctggagacctgtgggcttctggtttcactagggcatcgggttcccaaaccagagttggtccacctgctagagcatgggcaggagctgtggatagtgaagagaggcctctcacatgctacctgtgcaggtcaagaaccaaggaaagaagaagggcccatgtccaactctgggaaagacaggaaactcctggaaaaaggggaagagcagagtccagcagaggttgatggtgtggttttaagagatcttacctactgaggccata

SEQ ID NO: 202912 - DNA, 4564 bp, Homo sapiens
  Payload ID: 20016
  Gene Name: zinc finger protein 551
  Uniprot ID: Q7Z340
  ENST ID: ENST00000282296
  CDS Start-End: 186-2198
aacttccggcgtcctcctcgtggcggtcattttggcctctgtcctgtttgtccagcccgccagtttctgcagtggaggtcgcgactgagggacgggacagagaagtcgcgaaagtgggccagaggttctgcgacaccacctcgggtgagctgcgccaggcccgggatagggactgttgtgttcgaatgcccgccccggtcggccgccgctccccgcctagtccacggagctcaatggcggcagtcgcgctgagggactcggctcagggtatgacctttgaggatgtggccatttatttctcccaagaagagtgggagctccttgatgagtctcagaggttcctgtactgcgatgtgatgctggagaactttgcacatgtaacatccctgggttattgccatggaatggagaatgaggcgatagcttctgagcagagtgtatctatacaggtcaggacttctaagggcaatacacccacccagaaaactcacctcagtgagattaagatgtgtgtcccagtcttgaaagacattttgcctgcggctgagcaccaaaccacatcccctgtgcaaaagtcatacttgggtagcacaagcatgagaggcttctgcttcagtgctgaccttcaccagcatcaaaagcattacaatgaagaagagccctggaaaaggaaggtggatgaggctacatttgtgaccggctgcagattccatgtgttgaattatttcacctgtggggaggccttcccagcccccacggacctactccaacacgaagccactcccagtggtgaggagccacacagtagcagcagcaagcatatacaggcatttttcaatgcaaaaagttattacaagtggggtgaatacagaaaagcttcaagccacaaacacacacttgttcagcatcagagtgtctgttctgaaggagggctttatgagtgtagcaaatgtgagaaagccttcacttgcaagaacacacttgttcagcaccagcaaattcacactggacaaaagatgtttgagtgtagtgaatgtgaggaatcctttagcaaaaagtgccacctaatcttacacaagataattcacactggagaaaggccttatgaatgcagtgatcgtgagaaagcctttatccataaatctgaattcattcaccaccagagacgtcacactggaggagtgcgtcatgagtgtggtgaatgtaggaaaacctttagctacaaatctaacctcattgaacaccagagagttcacactggagaaaggccttatgaatgtggcgagtgcgggaaatcctttagacaaagctctagcctttttcgacaccagagagttcactctggagaaaggccttatcagtgctgtgagtgtgggaaatcctttagacaaatcttcaatctcattcgacatagaagagttcacactggagaaatgccttatcagtgcagtgattgtgggaaatcttttagctgcaaatcggaactcattcaacaccagagaattcacagtggagaaagaccttatgaatgcagagaatgtgggaaatcctttagacaattctctaacctcattcgacaccgcagcattcacactggtgataggccttatgagtgcagtgaatgtgagaaatcctttagccgcaaatttatcctgattcaacaccaaagagttcacactggagaaagaccttatgaatgcagtgaatgtggaaaatcctttacccgcaaatctgacctcattcaacaccggagaattcatactggcacaagaccttatgagtgcagtgaatgtggcaaatcttttagacagcgctctggcctcattcagcaccggagacttcatactggagaaaggccttatgaatgtagtgaatgtggaaagtcttttagccaaagtgctagcctcattcaacaccagagagttcacactggagaaaggccttatgaatgtagtgaatgtgggaaatcctttagccagagctctagcctcattcaacaccagagaggtcacactggagaaagaccttatgagtgcagtcaatgtgggaaaccctttacccacaaatcagaccttattcagcaccaaagagttcacactggagaaaggccttatgaatgcagtgaatgtgggaaatcctttagccgcaaatctaacctcattcgacatcggagagttcacactgaagaaaggccttaaatgtgaagggaatgtgctatttctttattcagtataatagcactggaggagactgtggtagccatcttcgtaaatttaaactttgagcacccacagtggggtattcttcataagtttcaggtatgtgggaagctctgaggaggttcattgtaatttctaatctgccgaggcctatagcctgatttatgtcactgccaatttctgaggctgaagccatttcacatttcacccctaccacctggcaggtgcacaccatgtgcatgagtcacttccccacagtgctcagagaagcaaacctctgtactctcccatttgcttggggaaattattaatagcccaagcatgtagggtcttcatgtcttttctctgactttagagtatacacctgacccagttgtggtccagagaatctgagttgtgctgtcagctttctaaggattacttttttaaggaacattgtcggtctcacatgatgcttgtaatgaatttttccacattctgattcaccagcctggaaactgcttggtgcacattgctttaatttataatgtttttataaaggttttaaaaaaatttacgcacctttaatcttgggtgttctattcattgcatagaatgacttgtaagcagaatagtgatgtcagcatgaaggggtgaatagattttgtggagatctcaaactttctgtactcagaagggacaatgtgatggcagaagacagctctttgttctgtattgctctaattggcctgctgcccaaggcctcaaagtaaagactgccaggctttgtgttcctgtattgtggcctggtgccatttttgtcaggtcagaggtcaccatgaaaaggaggcagttgtgacaatccccagtgcttctgtgaacgtgaattttgttcagttgtccacaggagatccacataattcctagcactggtgaggggaatctgttgcccaggtcctgcaaaggagccaggtgccatggcatataagtcagtgtagactggtgccatttgttgtcagactataggtgtggaggtgaaattacaggttcaacagtaattgggacagaaactccaggtaaatggggagtggagaagactgcagtaaattagatggaatgactcttctaaaagttcatctacaaattttccagtgaatatggttgtgtaggatcagtgcatacagaaattctcaggatcttctgtttactatcgctgagatcattatcagaaaatagtctggccgggcatggtgtaatcctaacactttgggaggccaaggcgggcggattgcctgagctcaggagttcaagaccagcctgggcaacatggtgaaatcccatgtctactaaaatacaaaaaattagccaggcgtggcagcatgcgcctatagtcccagccacttgggaggctgaggcaggagaatcgcttgaacccagaaggcggaagttgcagtgagctgagattgcaccactgcactccagcccaggcaacagagtgagactccgtctccaaaaaaaaaaaagaaaatagtctataaaggttttgtggctccttgtatcctgtctgggctgttcacctcaaggccattgctatgcaggtaggagaacaagaatagagagaaggatcattccgcggtccagggatgtggcttttgtgactcagccaacattcctattaattcaggtggcaacagccttcattgcttgccaaaatttgctgcccctgaggcaaggttgcctctctcagggcatgaggagagagagagatggtgaagtccatatcaggttgccaccctgattaaaaaaaaaggaacatctaggctcttaattttgagccactttttaaagctttttgaaggtctaatttgtataactgacatgcaacaaagtacacgtatccaaagtgtacagtttggtaaagccatgaaaccatcattacaaccataaaaatgaatttgtgtgtcacccatatatttaccttgtatctttttataatctttctcccttccccagctcttcaggttcaactgatttcctttacagtaaattagtttgcattttctggagtttttactgagatacatacacacacacacacacacacacacacacacgtatacgcatatacgtatacgtatatatatacatatgtgtttatatatgtgtgtgtgtatatatatatacttactggttttcttcatgctgtataattattttgagattcaaaaatgatgaatctttgtattgctgagtatcatgctgttctatggataagtcagtgtttatccatgtgtttagggacatttatattatttatagatttttgtatattacaaataaagctgctgtaaatacttgaattcatt

SEQ ID NO: 202913 - DNA, 469 bp, Homo sapiens
  Payload ID: 20016
  Gene Name: zinc finger protein 551
  ENST ID: ENST00000596085
  CDS Start-End: 178-354
ccgccagtttctgcagtggaggtcgcgactgagggacgggacagagaagtcgcgaaagtgggccagaggttctgcgacaccacctcgggtgagctgcgccaggcccgggatagggactgttgtgttcgaatgcccgccccggtcggccgccgctccccgcctagtccacggagctcaatggcggcagtcgcgctgagggactcggctcagggtatgacctttgaggatgtggccatttatttctcccaagaagagtgggagctccttgatgagtctcagaggttcctgtactgcgatgtgatgctggagaactttgcacatgtaacatccctggatcaagccaccaatatctgagagagaaatgctggcttcaggagagctcaagtcagaggatcccagcagggattttatacccttctggggtaacacagttgagccagagtgcctacctaatcatgtatgccaacca

SEQ ID NO: 202914 - DNA, 1826 bp, Homo sapiens
  Payload ID: 20016
  Gene Name: zinc finger protein 551
  ENST ID: ENST00000601064
  CDS Start-End: 158-1826
gacgggccggaacttccggcgtcctcctcgtggcggtcattttggcctctgtcctgtttgtccagcccgccagtttctgcagtggaggtcgcgactgagggacgggacagagaagtcgcgaaagtgggccagaggttctgcgacaccacctcggggtatgacctttgaggatgtggccatttatttctcccaagaagagtgggagctccttgatgagtctcagaggttcctgtactgcgatgtgatgctggagaactttgcacatgtaacatccctgggttattgccatggaatggagaatgaggcgatagcttctgagcagagtgtatctatacaggtcaggacttctaagggcaatacacccacccagaaaactcacctcagtgagattaagatgtgtgtcccagtcttgaaagacattttgcctgcggctgagcaccaaaccacatcccctgtgcaaaagtcatacttgggtagcacaagcatgagaggcttctgcttcagtgctgaccttcaccagcatcaaaagcattacaatgaagaagagccctggaaaaggaaggtggatgaggctacatttgtgaccggctgcagattccatgtgttgaattatttcacctgtggggaggccttcccagcccccacggacctactccaacacgaagccactcccagtggtgaggagccacacagtagcagcagcaagcatatacaggcatttttcaatgcaaaaagttattacaagtggggtgaatacagaaaagcttcaagccacaaacacacacttgttcagcatcagagtgtctgttctgaaggagggctttatgagtgtagcaaatgtgagaaagccttcacttgcaagaacacacttgttcagcaccagcaaattcacactggacaaaagatgtttgagtgtagtgaatgtgaggaatcctttagcaaaaagtgccacctaatcttacacaagataattcacactggagaaaggccttatgaatgcagtgatcgtgagaaagcctttatccataaatctgaattcattcaccaccagagacgtcacactggaggagtgcgtcatgagtgtggtgaatgtaggaaaacctttagctacaaatctaacctcattgaacaccagagagttcacactggagaaaggccttatgaatgtggcgagtgcgggaaatcctttagacaaagctctagcctttttcgacaccagagagttcactctggagaaaggccttatcagtgctgtgagtgtgggaaatcctttagacaaatcttcaatctcattcgacatagaagagttcacactggagaaatgccttatcagtgcagtgattgtgggaaatcttttagctgcaaatcggaactcattcaacaccagagaattcacagtggagaaagaccttatgaatgcagagaatgtgggaaatcctttagacaattctctaacctcattcgacaccgcagcattcacactggtgataggccttatgagtgcagtgaatgtgagaaatcctttagccgcaaatttatcctgattcaacaccaaagagttcacactggagaaagaccttatgaatgcagtgaatgtggaaaatcctttacccgcaaatctgacctcattcaacaccggagaattcatactggcacaagaccttatgagtgcagtgaatgtggcaaatcttttagacagcgctctggcctcattcagcaccggagacttcatactggagaaaggccttatgaatgtagtgaatgtggaaagtcttttagccaaagtgctagcctcattcaacaccagagagttcacactggagaaa

SEQ ID NO: 202915 - DNA, 2352 bp, Homo sapiens
  Payload ID: 20017
  Gene Name: zinc finger protein 552
  Uniprot ID: Q9H707
  ENST ID: ENST00000391701
  CDS Start-End: 171-1394
agtagcgaccatttccattggcgttagggagtccttggagcgctgtgttgggaccgtggtggtgactggatccaggaggtcgagagtcgttcttctctttgcacagacgtgactctgcagctctttaacggcgcccgctgctctcaacccagcttaccccacgtggtcccatggcggcggccgcgctaaggttccccgttcagggcacagtgacttttgaagacgtggctgtgaaatttacccaggaggaatggaatctccttagtgaggctcagagatgcctgtaccgtgatgtgacgctggagaacctggcacttatgtcctccctgggttgttggtgtggagtggaagatgaggcggcaccttctaagcagagtatttatatacaaagagagactcaggtcaggactcctatggcaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgcgaagaggtgtaagttgcatgtgtcaggggagtcatctgtcttcagtgagagtgggaaagactttttgctcaggtcaggattactccagcaagaggccactcacactgggaagtcaaacagcaaaactgagtgtgtgtctctgtttcatgggggaaaaagccattacagctgtggaggatgcatgaaacattttagcaccaaagatatactcagtcagcacgagagactgctccctacagaagaaccttctgtgtggtgtgaatgtgggaaatcctctagcaaatatgacagcttcagtaatcatcaaggagttcacactagagaaaaaccttatacgtgtgggatatgtgggaaattatttaacagtaagtcccacctccttgtacaccagagaattcacactggagagaagccatatgagtgtgaggtttgtcagaaattttttaggcacaagtaccacctcattgcacaccagagagttcacactggagaaaggccatatgaatgcagtgattgtgggaagtcatttacccacagctctacattccgtgttcataagagagttcacactggtcagaagccttatgagtgcagtgaatgtgggaaatcttttgccgaaagctccagtctcactaaacacaggagagttcacactggagaaaagccttacgggtgcagtgaatgtgaaaaaaaatttaggcaaatctcttcacttcgtcatcatcagagagttcacaaaagaaagggcttatgagtgcagtgagtccagtctcattaaatattggagaatacacacctgagtaagatcctgtgattgcagcaaatgtggaaaatgtttacccaaaggtctgctctccttggatattggagagttcacactagagaagagtccttacaagtaaaataaatttgggcagttttgtagccacacctctgtattccttcaggattatagttaacactgaatgaaggccttactagtgtgacaaatacaggatatttatccagaagtctggctgcataactcacaggagagctgtcatgtgggaggattgctacatgggaggatttgcttgagcctgggaggcagaggttgcagtgagccgagattgcaacactgcagtccagtctggaccacagagtgagaccctgtttcaaaaataaaatatataaatgacatccaataaagtatgcatatttgagctgtaggataagtcttgaattttctttttcttttttttgagacagcctcgctctgtcacccaggctggagtacagtggcataatctcggctcactgcaagccctgcctcctgggttcatgccattctcctgcctcagcctccctaatagctgggactacaggcaaccaccaccactcctaccttttttgtatttttagtagagatggggtttcaccctgttagccaggaagttctcaatctcctgacctcgtgatctgcccgccttggcctctcaaagtgttgggattgcaggcgtgagccactgctcctggcttgaattttcttataatcccatgaaaccatcatcagagtcacaataatgaatttatctaatctatcacctttgtattcacctggagcctttataaagtttttctctatgcagacaaccattgatttactctgctgtataatactttccattttctagaattttctgactgatgtaataaagtgtttcctcttataa

SEQ ID NO: 202916 - DNA, 1703 bp, Homo sapiens
  Payload ID: 20017
  Gene Name: zinc finger protein 552
  ENST ID: ENST00000596248
  CDS Start-End: 171-320
agtagcgaccatttccattggcgttagggagtccttggagcgctgtgttgggaccgtggtggtgactggatccaggaggtcgagagtcgttcttctctttgcacagacgtgactctgcagctctttaacggcgcccgctgctctcaacccagcttaccccacgtggtcccatggcggcggccgcgctaaggttccccgttcaggtaattgtggcgccttccgtgctctccggtcacctcctagtcacacaagtcctaaagcagcgagggagcggcacctgtttacggctctgcaacccggacccggcgtcgggacactgaggcgctctcgggagggatccctgtttcagacacccgtgggatgcggtggggagagcgacagggcacagtgacttttgaagacgtggctgtgaaatttacccaggaggaatggaatctccttagtgaggctcagagatgcctgtaccgtgatgtgacgctggagaacctggcacttatgtcctccctgggttgttggtgtggagtggaagatgaggcggcaccttctaagcagagtatttatatacaaagagagactcaggtcaggactcctatggcaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgcgaagaggtgtaagttgcatgtgtcaggggagtcatctgtcttcagtgagagtgggaaagactttttgctcaggtcaggattactccagcaagaggccactcacactgggaagtcaaacagcaaaactgagtgtgtgtctctgtttcatgggggaaaaagccattacagctgtggaggatgcatgaaacattttagcaccaaagatatactcagtcagcacgagagactgctccctacagaagaaccttctgtgtggtgtgaatgtgggaaatcctctagcaaatatgacagcttcagtaatcatcaaggagttcacactagagaaaaaccttatacgtgtgggatatgtgggaaattatttaacagtaagtcccacctccttgtacaccagagaattcacactggagagaagccatatgagtgtgaggtttgtcagaaattttttaggcacaagtaccacctcattgcacaccagagagttcacactggagaaaggccatatgaatgcagtgattgtgggaagtcatttacccacagctctacattccgtgttcataagagagttcacactggtcagaagccttatgagtgcagtgaatgtgggaaatcttttgccgaaagctccagtctcactaaacacaggagagttcacactggagaaaagccttacgggtgcagtgaatgtgaaaaaaaatttaggcaaatctcttcacttcgtcatcatcagagagttcacaaaagaaagggcttatgagtgcagtgagtccagtctcattaaatattggagaatacacacctgagtaagatcctgtgattgcagcaaatgtggaaaatgtttacccaaaggtctgctctccttggatattggagagttcacactagaga

SEQ ID NO: 202917 - DNA, 335 bp, Homo sapiens
  Payload ID: 20017
  Gene Name: zinc finger protein 552
  ENST ID: ENST00000594473
  CDS Start-End: 1-188
aagacgtggctgtgaaatttacccaggaggaatggaatctccttagtgaggctcagagatgcctgtaccgtgatgtgacgctggagaacctggcacttatgtcctccctggggaaagaaacagtagctccactcctgccggtccctcccctaggggagagggaagcagaggagaaaacagcagcataggtggctggcaaagacaaaggaaagaccagtagaagagaaagaaaccaaaaacagcaagcgcagagccaaacagccaggcaggcaggccaaaggttaagtccctctccccagccctgcggtttgtgaaaaagagggtgggcaccggct

SEQ ID NO: 202918 - DNA, 2736 bp, Homo sapiens
  Payload ID: 20018
  Gene Name: zinc finger protein 554
  Uniprot ID: Q86TJ5
  ENST ID: ENST00000317243
  CDS Start-End: 199-1815
gagtttacctctgcgcgcgtcggggttggtggcggcggctgcggcgagttcctgaggggcgcctgcggggggcgtccgctccgagcgccgaggagccgagcggaggaggcgtcccagggacacgcaggggaggccggccggcctgcacggggcgctcccgcctcgggggccctgtctggcgcctcagcgcgcgccccgatggtcacctgcgcccacctgggccggcgcgcgcggctcccggcagctcagccctctgcctgcccaggaacctgcttttcccaagaggagagaatggctgctgggtacctgccccgctggtcccaggaattagtaacctttgaggacgtgtccatggacttctcccaggaggagtgggagttgctggagcctgctcagaagaacctgtacagagaggtgatgctggagaactacaggaacgtggtctccctggaagccttgaagaaccaatgtactgatgtggggattaaagagggtccactttccccagcacaaacctcacaagtcactagtctttcctcatggacggggtatttactttttcaaccagtggcttcttcccacttggagcaaagagaagccctgtggatagaggaaaaaggaactcctcaagcctcctgttcagattggatgactgtactaagaaaccaagactcaacttacaagaaggtggctttgcaggaggaaccagccagtggtataaatatgataaagcttatcagagaagatgggggatggaagcagttagaggacagccatgaagacccccaggggcttttgagccaaaaggcatcccttcacgtagtggccgttcctcaggagaaggctactgcatggcatggatttggggaaaatggtaatctgagcccagcccttgttttatcacagggaagctctaaagggaaccacttgtgtggcagcgagttagatattacaagcttggcatccgattcagtcttaaaccaccatcagctgggatatgcagatcggagaccttgtgaaagtaatgaatgtggaaatgccatccgccagaacagtcactttattcaacacggggggaagatgtttgtgtatttggaaaatgggcagtcattgaaccacggtatggccctgactatccacaacaaaatcaacacggcagagaaaccctttgagtgccaccagtgtgggaaggtgttcaaccggaggcattctttgagcgaacatcaaagaattcacacgggggagaaaccctacgagtgtcaggagtgtgggcgagcctttacgcacagctccaccctcacgcgccatctgagaactcatactggagagaagccctacgggtgcggtgagtgcgggaaagccttcaacaggatctcatcgctgactcagcatcagaggattcacaccggggaaaagccctataaatgtgaagactgtgggaaatccttctgccagagctcttacctgatcttgcacaagaggacacacaccggagagaagccctacgaatgcagtgaatgtggaaaggccttcagtgaccgttcctctctcaaccagcacgagcgaactcacacgggcgagaacccctatgaatgtaagcagtgtgggagagccttcagccagaggtcttcccttgtgaggcacgagagaactcacactggagagaaaccctacaggtgtcaggaatgtgggaaagccttcagccagagctcatcccttgtcacacatcagaaaactcacagcagccagaaaacctataaaatcattgactgtgggaaagcgttctaccagaacagacatcttattggatattagcaattgcacgctgctttgtaagccactttttagtactctgacacatacatgtggttatcttttgccctgttgtgatggataatttgaaaagaagtgggtttatgtcaccttctcaccttcttataagaaagctctgagaatgggcatttttgtattttgttgttgttgttgagatggagtctgccacccaggctggagtccagtggcgtgatcatacctcactgcagcttcaacttcctgggctcaagtaatcctcccaccccagcctcccaggtagctagtactataggtgtgcaccaccacgcccagcaaatttttaaatttattatagagtgggaggcagggtgcggtggctcatgcctataatcctaacactttaggaggccgaggcgggtggatcatgaggtcaggagatcgagaccatcctggctaacacagtgaaaccctgtctctactaaaaatacaaaaaagtagccgggcgtggtggtgggcgcctgtagtcccaactactcaggaggctgaggcaggagaatggtgtgaacccgggaggtggagcttgcagtgagccgagatcgcaccactgcactccagcctgggagacagagcgagactccgtctcaaaaaaaaaaaaaaaattatagagttggggtcttgctacattgccaagactggtcttgaactcctggggtcaagcatcctcctgtcttggcctcccaaagtgttgggattagaagcatgagccgctgtgcccagcctgacggggccttttagtgggaggagttgccattacactacgtccagtaagctccagactttcggaaaagattggtggacgggaatgctgtcatggatgggatcttgccaagaaccatcacgtgttaatttagttgcttaaacaaaaggtgttctgtttcttaacta

SEQ ID NO: 202919 - DNA, 2486 bp, Homo sapiens
  Payload ID: 20018
  Gene Name: zinc finger protein 554
  ENST ID: ENST00000590116
  CDS Start-End: 154-360
gagttcctgaggggcgcctgcggggggcgtccgctccgagcgccgaggagccgagcggaggaggcgtcccagggacacgcaggggaggccggccggcctgcacggggcgctcccgcctcgggggccctgtctggcgcctcagcgcgcgccccgatggtcacctgcgcccacctgggccggcgcgcgcggctcccggcagctcagccctctgcctgcccaggaacctgcttttcccaagaggagagaatggctgctgggtacctgccccgctggtcccaggctggattgccgtggcacaatctccgctcactgcaacctctgcctcccggttcaagcgattctcctgcctcagcctcctgagtagctgggactacaggaattagtaacctttgaggacgtgtccatggacttctcccaggaggagtgggagttgctggagcctgctcagaagaacctgtacagagaggtgatgctggagaactacaggaacgtggtctccctggaagccttgaagaaccaatgtactgatgtggggattaaagagggtccactttccccagcacaaacctcacaagtcactagtctttcctcatggacggggtatttactttttcaaccagtggcttcttcccacttggagcaaagagaagccctgtggatagaggaaaaaggaactcctcaagcctcctgttcagattggatgactgtactaagaaaccaagactcaacttacaagaaggtggctttgcaggaggaaccagccagtggtataaatatgataaagcttatcagagaagatgggggatggaagcagttagaggacagccatgaagacccccaggggcttttgagccaaaaggcatcccttcacgtagtggccgttcctcaggagaaggctactgcatggcatggatttggggaaaatggtaatctgagcccagcccttgttttatcacagggaagctctaaagggaaccacttgtgtggcagcgagttagatattacaagcttggcatccgattcagtcttaaaccaccatcagctgggatatgcagatcggagaccttgtgaaagtaatgaatgtggaaatgccatccgccagaacagtcactttattcaacacggggggaagatgtttgtgtatttggaaaatgggcagtcattgaaccacggtatggccctgactatccacaacaaaatcaacacggcagagaaaccctttgagtgccaccagtgtgggaaggtgttcaaccggaggcattctttgagcgaacatcaaagaattcacacgggggagaaaccctacgagtgtcaggagtgtgggcgagcctttacgcacagctccaccctcacgcgccatctgagaactcatactggagagaagccctacgggtgcggtgagtgcgggaaagccttcaacaggatctcatcgctgactcagcatcagaggattcacaccggggaaaagccctataaatgtgaagactgtgggaaatccttctgccagagctcttacctgatcttgcacaagaggacacacaccggagagaagccctacgaatgcagtgaatgtggaaaggccttcagtgaccgttcctctctcaaccagcacgagcgaactcacacgggcgagaacccctatgaatgtaagcagtgtgggagagccttcagccagaggtcttcccttgtgaggcacgagagaactcacactggagagaaaccctacaggtgtcaggaatgtgggaaagccttcagccagagctcatcccttgtcacacatcagaaaactcacagcagccagaaaacctataaaatcattgactgtgggaaagcgttctaccagaacagacatcttattggatattagcaattgcacgctgctttgtaagccactttttagtactctgacacatacatgtggttatcttttgccctgttgtgatggataatttgaaaagaagtgggtttatgtcaccttctcaccttcttataagaaagctctgagaatgggcatttttgtattttgttgttgttgttgagatggagtctgccacccaggctggagtccagtggcgtgatcatacctcactgcagcttcaacttcctgggctcaagtaatcctcccaccccagcctcccaggtagctagtactataggtgtgcaccaccacgcccagcaaatttttaaatttattatagagtgggaggcagggtgcggtggctcatgcctataatcctaacactttaggaggccgaggcgggtggatcatgaggtcaggagatcgagaccatcctggctaacacagtgaaaccctgtctctactaaaaatacaaaaaagtagccgggcgtggtggtgggcgcctgtagtcccaactactcaggaggctgaggcaggagaatggtgtgaacccgggaggtggagcttgcagtgagccgagatcgcaccactgcactccagcctgggagacagagcgagactccgtctc

SEQ ID NO: 202920 - DNA, 1148 bp, Homo sapiens
  Payload ID: 20018
  Gene Name: zinc finger protein 554
  ENST ID: ENST00000591265
  CDS Start-End: 123-668
cgctccgagcgccgaggagccgagcggaggaggcgtcccagggacacgcaggggaggccggccggcctgcacggggcgctcccgcctcgggggccctgtctggcgcctcagcgcgcgccccgatggtcacctgcgcccacctgggccggcgcgcgcggctcccggcagctcagccctctgcctgcccaggaacctgcttttcccaagaggagagaatggctgctgggtacctgccccgctggtcccaggaattagtaacctttgaggacgtgtccatggacttctcccaggaggagtgggagttgctggagcctgctcagaagaacctgtacagagaggtgatgctggagaactacaggaacgtggtctccctggaagccttgaagaaccaatgtactgatgtggggattaaagagggtccactttccccagcacaaacctcacaagtcactagtctttcctcatggacggggtatttactttttcaaccagtggcttcttcccacttggagcaaagagaagccctgtggatagaggaaaaaggaactcctcaagcctcctgttcagtctcgctcttgttgcccaggctacagtgcagtggtgtgatctcggctcactgcaacctccacctcccaggttcaagcgattcttctgcctcagcctcttgagtacagattggatgactgtactaagaaaccaagactcaacttacaagaaggtggctttgcaggaggaaccagccagtggtataaatatgataaagcttatcagagaagatgggggatggaagcagttagaggacagccatgaagacccccaggggcttttgagccaaaaggcatcccttcacgtagtggccgttcctcaggagaaggctactgcatggcatggatttggggaaaatggtaatctgagcccagcccttgttttatcacagggaagctctaaagggaaccacttgtgtggcagcgagttagatattacaagcttggcatccgattcagtcttaaaccaccatcagctgggatatgcagatcggagaccttgtgaaagtaatgaatgtggaaatgccatccgccagaacagtcactttattcaacacggggggaagatgtttgtgtatttggaaaatgggcagtcattgaacc

SEQ ID NO: 202921 - DNA, 8557 bp, Homo sapiens
  Payload ID: 20019
  Gene Name: zinc finger protein 555
  Uniprot ID: Q8NEP9
  ENST ID: ENST00000334241
  CDS Start-End: 139-2025
cgagctctgtctaatcaggcccctgggacgggacgcctctgtcctagccgtgagtgccccgcctgcccctagcggtccctggcgtcccggttcctgtcgcgctcacctgcgccggtagcgaagaaatcgccccgggacatggactcagtggtctttgaggatgtggctgtggacttcaccctggaggagtgggctttgctggattctgctcagagggacctctacagagatgtgatgctggagacctttcagaacctggcctcagtagatgatgaaactcaatttaaggccagtgggtcagtttctcagcaggatatttatggagagaaaatacccaaggaatctaaaatagccacgttcaccagaaatgtttcctgggcctctgttttaggaaaaatttgggacagtcttagcatcgaagatcaaaccacaaaccaggggagaaatctcagtagaaatcatgggttggagagactctgtgaaagtaatgatcaatgtggagaagccctcagccagattccacatcttaatctgtacaagaaaattccacctggagtaaaacagtatgaatacaacacgtacggaaaagtcttcatgcatcgccgcacatccctcaagagtcccatcacagttcacactggacacaaaccatatcagtgccaggaatgtgggcaggcctacagttgtcgttcacacctaagaatgcatgtgagaacccacaatggagagagaccctatgtgtgtaaattatgtgggaaaacctttcctcgtacttcctccctcaatcggcatgtaaggattcacactgctgagaaaacctacgaatgtaagcaatgtgggaaagcctttattgacttctcaagtcttactagtcatctcagaagtcacaccggagagaagccatataagtgtaaggaatgtgggaaagctttcagttattcctcaacgtttcgaagacacacaataacacacactggcgagaagccatataaatgtaaggaatgtgcggaagcctttagttattcctcaacttttcgaagacatatgatttcacacactggagagaagccacataaatgtaaagaatgtggggaggccttcagttattcttcggcttttcgaagacacatgataacacacactggagagaaaccctacgaatgcaaacaatgtgggaaaaccttcatttatctccagtcctttcgaagacatgaaaggattcacactggagagaaaccctacgaatgcaaacagtgtgggaagaccttcatttatccccagtcctttcgaagacatgaaaggactcatggtggagagaaaccctatgaatgcaaccagtgcgggaaagcattcagtcacccctcctcctttcgaggacacatgagggtgcacactggagagaaaccctatgagtgcaagcaatgtgggaaaactttcaattggcccatatctttacgaaaacatatgagaacacatactagagagaaaccctatgaatgtaagcagtgtgggaaagccttcagcttgtctgcttgctttcgagaacatgtgagaatgcaccctgaagacaaatcctatgaatgcaagctatgtgggaaagctttctattgccacatatccttacaaaaacatatgagaagacataccgcagagaaactctataaatgcaagcagtgtgggaaagctttcagttggcctgaacttttgcaacaacatgtgagaacgcacactgtagagaagccctatgaatgtaaggaatgtgggaaggtcttcaaatggccatcatctttaccaatacatatgagactgcacactggagagaaaccttatcaatgtaagcattgtgggaaagcattcaattgttcctcatccttaaggcgacatgtgagaatacacactacagaaaaacagtataagtgtaatgtaggacatcctcctgcaaatgaattcatgtgcagtgcttcagaaaagtcacaccaggagagagatctgatcaaagttgtaaatatggtgttgcctttatgagttccttatcctgaaagtggacactcaaggagtgtgtctgtagttcatttgcaaataaacatttagttgaaaaataattctccaaatactctcagctatcctacatgaatttgaacaggtagtttcttacgattcagtaaataaaactttcatcttagagtgttttggactcatggatgatttgaagtgtatttttaatatgcaagtaggttcaagttttatttaatttcttaaattgtaactgacttagtgtgacaggtattggatattacgtatctattatattttccaccttttttactgggagtatttttattgtttggccagaggagccttattccattttttaagaagtagttggcagaattttgtaattatgcaaagttgtttaaggagtatagcctcaaatgaattgtaatttttaatgtttgcccattgctgtttgtctttgcttgtgattgtgaattggacagtaggctttgacttgtgatgtgacggagaaatccagagttgcagatagttcttctgcattgttgtcagtgtgggtagtgttaggaacttcatttgctggaatgcatttcctttatggttccatgtccaaatttaccaatagcaataacttgaatgaaatttagaatgaagaagaagtaagtcatcgctgagcttttggggtcacattaaatggagatggacagatgcataggggctttgtgaacatcaaccttcagcttattttccagattcttattcctgccaatcaagagtaccatcaaaagaaacacttaagtgcttgatttccactgtgtcagaggtgtagtcttcctcagacatctccattaacttgatattagggatattcctgtgtggtcagtcacctagagtctggatttttctcaaaaccctgcatgacctcttgaccactgattcagactgtcttgtttggcagtctctgagcttctgattctcccgttctgtagatcttaacatatttgcatggggtctaatttatatagtgaacaccttgttatcttaatacttccagtggctctgtgatcctgattccaccacgaaagccacagtgttgcagtcaaagaagaaaaacaacacatgggactttgtaccctattgcatttttaagtgtgcctgccgagtcctatgtgagaacaaataccttcctcatatattagatttagggagatttctgttactcagaactaaatgcagtttcttgatataggttaaattattaggtttgattatgtatcattaaaaataatgtggattttgtttcaaggaaaaccttctgtagatatttcttagaaatatcctgtttagctgggcacagtagctcatgcctgtaatccctgcactttgggaggcttgaggtcaggagtttgagaccagcctggttaacatggtgaaaccctgtctctactaaaaacacaaaaattagccaggcatggtggtgagtacctgtaaccccagctacttgggaggctgagacaggagaagtgcttgaacctaggaggcggaggttgcagtgagccaagatcacaccactgcactccagcctgggagacggggaaagactccatcacacaagcaagaaaagaaaaaaaaatcctatttactgtgctttcaaattagttgtttagagactatattaatttcccagggctgccataacaaagtacaaaaactgggtgacataggaaaacaaactttttgtttctcagttctggacccagaaatccagaaacaaggcattggcaggaccatgctttttctgaagatgctagggaaggatctgtttcagaactcacctagcttctggtagttccttagcttgtggcagcataactctaattttcacatggcattctccctgtgtgtgtgtctctccatgtgacaatatttttatacatacacaccactcattgggttaggccccactctacttcagtatgattttaccttaactaattacattggcaacagctctcttttcgcatactgaggcaccgcgaattaagatttcaacgtaaaaattttaggagacccaattcaacccataacactaagaaatgttattttttgtttaccgagagaattacagatttcaaatcaactttgtaattttgataatttaagcatgttacattttgaatcagtattaccaagtatatacaaatacaggtattttttcatataaatgttatttttaattgctgtatacttaacatttgccattaaaatgattttttttttttgagacagagtctcgctctgtcacccaggctggagtgcagtggcacgaccttagctcactgcaaccttcatctcccaggttcagttgattctcctgcctcagcctcccgagtagttgggattacaggcatgcaccaccacacccagctaatttttttatttttggtagagatggggtttcaccatgttggccaggctggtcttgaactcctgacctcaggtgatctgcccaccttggcctcccaaagtgttgggattacaggcatgagccaccacacccggcctaaaatgatttcttatttgtggttaataacaattaaaaagcggaaataatggttttgtcaaggccctctacccagaaaccaccaggatcacactggtagtcaaagaaaatttgctgtgttgagttgaagtttgaacacatgatcaagaaagggctgtggcttgtatcagagggtgtttaaaaggatttactatcagatttggccttgtgttctgtgattttggtgagcgttcaaggaagccaggctttggtctggattggatgttctcaggtcatgaatataattctctgggaactcccaaagttctcatctacaaagcagaagttaattggagctgaaaactaatcagtaaagccacagcagccagtcatatgggggagaagaggggaatgtttgatggtttttgtggtttagaggtgagttccggaaaaaaagaagacatgtttgacatcctcaaacgagaaaatttttcatgtgttttataggccaaggaggcagaagcttttgttttaatgagccagaaagccccaaaagcctatttaagttttctcaggtatcatttcaacctctgaacttccagaattaactagggaagaggaaaaacatgtaacaccttagagttttattaaagagcaaacaatatccagtaatctccattactttccatgttaacataagttttcataacgctctatagatgaatgtgatttggcagtcacttgtatttcttaacacccacttacccatcattccctcttagatgaaaaaagttaagcacggggacaacagagtcttgtatattcatgtagctcatgatgatggaatcaagtttgaaggcttaacctgtgcttaacctatattgggcattgtcaagacttaaatttagaacactggaaagcaagtataattaattttacaaatagggcatcaaattttacaaagactcctaaggctatatggtattccttttataagacatggaaaaggcaaagataagggaaacgaacaaatcgctggttagaagtaggggatttgagtacatatgggcttaagagtgttctgtcatgattgtagtggtgaaaacaagcatttgcaaaaactcataaggctactcttaaaatagcaaattttgttgtatgtatattttaaagttaaacaataaaaatgctttcagtttattaaagaactcaagaccaggtgcagtggctcatgcctataatcccagcactttgggaagctgaggcgggaggattgcttgtggccaggaggttgaggctgcagtgaactatgatcatgcactgcactctacactgggcgacagagcaagaccctgtctcaaaaaaaaaggaatacaaaacattcctgaaacttgacatgtaagttcgcaataagacttttccctagctgggcgcggtgactcatgcctgtaatctcaacattttgggagactgaggcaagaggatcacttgaagtcaggagctagacaccagtctgggcaacatagcgagacctcaactctaccaaaaaattaaaaagtgagccaggcggggtggtgcacgtctgtggtcccagctacttggcaggctgaagcaggaggatcacttgaggccttgaggagccatgatcgtgccactgcactccagcttgggtgacagagcaagactgtctcaaaaaataaaaataaaaaaacaagacttcccccaccatcttggaattctctggaggaaatgtagggctggttgacaaggacttgtgcctcgtcagaccctgtttgaaacccagtctgaagttttgaaacacccacaagggccatacctgactttatctcacgcacataacaggagagaagaaggaggtcttccagaatctgtctttgagtttacaccaggttcttcccatctgatctttgggaatgctgtggttctgaaacataaaacggggaccctacacttcttcccaggaatatcctgcctgggagcatcctgatcctgtcttcagacaaggggcatccgcatcttgttttctagggcctttcctgaggccacttccagctccaaagttctcatctcaagctcagctctgtgtcttcatgctgggaaacgtctttatggatccccaaactcctcttgctgttgggaacacgtggcagccctgcgttgtgaggtgagagaagaggcagtggcagaacccatgccatggagacacgcccatcagccacagcagctcctgctactgcataaatccataggcacaatcacacgcctcacggtgtcaacatctcccatgacatcacaaagatgcccagctgggacccacctacagtgatggggtgatggggtttcacctataagcgggcaaacaggcactcctcctcactgtccagtcacctgacgtgctttttctgcgcactcaggtcgtgacaccccaggaggtgcctatcgcgccccaagctcctcacgtgcctcctccccacagtccaggacgcgtcttactaacgcctcaccagagcgcatgcgccctcctcaggagcagcctcaaagcgcgcagcctcagcccattggcctgcgggaagtggagttcccgaacagaagcccctcagtctccggaagccccgcccggcagactgttcccaggatgcaacacgggctcgcgtctaaaagagctgtgctttgttggggctatctgggagtttccgccttccatgaagtgcgcaggcgcacttaggcgaggcggggcgactctaggaagtggagacatcaagagtggtactggaagtggcggaagctctcctcttgccctcttcagcttccggtgtggtgggtcccggatatcgcgtggctgtggcaggtagacagcccgtgctccagaggccttcatcttgtgatggcagatgtacttgagtagacacgacagacggggaaggaccctgatggtccgagggaccttccacagcaagtagaaggcactgctgtgaatatgatggcgtcagaggtgactgcaaaaaaggacagggcagctgggcgaggaagagataccagtgatgtcctaactgagctccctgggtctggtagtgaggagctcagtcttagaatatgagccgtgtcaggggctacagcatcatcactcttgtcctgtcgcagactcaggctccctgttctcaggttcttatgtagacagtgagggctcagggaggctcccaccaccaccaccaccagcaccaccactccatcaaaacggctgaaggaccttcctttagggttcgggggatctcctccttccacaagggatggatgtgaagacaactcattctttgatgttcagatggttgtggccctctgatgagatgtgtgcacaccttgccaaatgcatatgtctgttgagcctggacattaagtatttcttgatgttcttctgtgtaacaggtgatgtcctaggtgctgcagtgaacagaagagacaaaatatccttgttcccttgaagctaatgtcgtaggggcccaaaacaaagcaaacaaacaaaaaaaaggaatgcaagtcaagtacactttgtatggacagtggtaattcctaagaaggaaaacaaagatggacttaaggggtgcagagggcctggactatgtgtgtctgtgggatagtctgttactacctctgggactctcatctcttgagtgtgcttgggtgtgtccaaccgtttttcctagtgacaaagtctgggtaattctgtggggacatatattggtgtatctgggaggtcccatgtgtctcagtggtggtccctgttttcaggaaagagtgtctgtgaatgtccatgtgtctcactgcacagctgtgatttttctgtgtctctgtgttttccagtctttgtgtgatgaaatataaaggcctagcaggctcagagttattaatgaattgtacttaagcgttgagaggcatatatttattgcactattaaattcttccaaaatatagttaaaaaaaaaa

SEQ ID NO: 202922 - DNA, 475 bp, Homo sapiens
  Payload ID: 20019
  Gene Name: zinc finger protein 555
  ENST ID: ENST00000585966
  CDS Start-End: 141-475
agctctgtctaatcaggcccctgggacgggacgcctctgtcctagccgactcagtggtctttgaggatgtggctgtggacttcaccctggaggagtgggctttgctggattctgctcagagggacctctacagagatgtgatgctggagacctttcagaacctggcctcagtagatgatgaaactcaatttaaggccagtgggtcagtttctcagcaggatatttatggagagaaaatacccaaggaatctaaaatagccacgttcaccagaaatgtttcctgggcctctgttttaggaaaaatttgggacagtcttagcatcgaagatcaaaccacaaaccaggggagaaatctcagtagaaatcatgggttggagagactctgtgaaagtaatgatcaatgtggagaagccctcagccagattccacatcttaatctgtacaagaaaattccacctggagtaaaacagtatga

SEQ ID NO: 202923 - DNA, 2270 bp, Homo sapiens
  Payload ID: 20019
  Gene Name: zinc finger protein 555
  Uniprot ID: Q8NEP9
  ENST ID: ENST00000591539
  CDS Start-End: 130-2013
tctaatcaggcccctgggacgggacgcctctgtcctagccgtgagtgccccgcctgcccctagcggtccctggcgtcccggttcctgtcgcgctcacctgcgccggtagcgaagaaatcgccccgggacatggactcagtggtctttgaggatgtggctgtggacttcaccctggaggagtgggctttgctggattctgctcagagggacctctacagagatgtgatgctggagacctttcagaacctggcctcagtagatgatgaaactcaatttaaggccagtgggtcagtttctcagcaggatatttatggagagaaaatacccaaggaatctaaaatagccacgttcaccagaaatgtttcctgggcctctgttttaggaaaaatttgggacagtcttagcatcgaagatcaaaccacaaaccaggggagaaatctcagaaatcatgggttggagagactctgtgaaagtaatgatcaatgtggagaagccctcagccagattccacatcttaatctgtacaagaaaattccacctggagtaaaacagtatgaatacaacacgtacggaaaagtcttcatgcatcgccgcacatccctcaagagtcccatcacagttcacactggacacaaaccatatcagtgccaggaatgtgggcaggcctacagttgtcgttcacacctaagaatgcatgtgagaacccacaatggagagagaccctatgtgtgtaaattatgtgggaaaacctttcctcgtacttcctccctcaatcggcatgtaaggattcacactgctgagaaaacctacgaatgtaagcaatgtgggaaagcctttattgacttctcaagtcttactagtcatctcagaagtcacaccggagagaagccatataagtgtaaggaatgtgggaaagctttcagttattcctcaacgtttcgaagacacacaataacacacactggcgagaagccatataaatgtaaggaatgtgcggaagcctttagttattcctcaacttttcgaagacatatgatttcacacactggagagaagccacataaatgtaaagaatgtggggaggccttcagttattcttcggcttttcgaagacacatgataacacacactggagagaaaccctacgaatgcaaacaatgtgggaaaaccttcatttatctccagtcctttcgaagacatgaaaggattcacactggagagaaaccctacgaatgcaaacagtgtgggaagaccttcatttatccccagtcctttcgaagacatgaaaggactcatggtggagagaaaccctatgaatgcaaccagtgcgggaaagcattcagtcacccctcctcctttcgaggacacatgagggtgcacactggagagaaaccctatgagtgcaagcaatgtgggaaaactttcaattggcccatatctttacgaaaacatatgagaacacatactagagagaaaccctatgaatgtaagcagtgtgggaaagccttcagcttgtctgcttgctttcgagaacatgtgagaatgcaccctgaagacaaatcctatgaatgcaagctatgtgggaaagctttctattgccacatatccttacaaaaacatatgagaagacataccgcagagaaactctataaatgcaagcagtgtgggaaagctttcagttggcctgaacttttgcaacaacatgtgagaacgcacactgtagagaagccctatgaatgtaaggaatgtgggaaggtcttcaaatggccatcatctttaccaatacatatgagactgcacactggagagaaaccttatcaatgtaagcattgtgggaaagcattcaattgttcctcatccttaaggcgacatgtgagaatacacactacagaaaaacagtataagtgtaatgtaggacatcctcctgcaaatgaattcatgtgcagtgcttcagaaaagtcacaccaggagagagatctgatcaaagttgtaaatatggtgttgcctttatgagttccttatcctgaaagtggacactcaaggagtgtgtctgtagttcatttgcaaataaacatttagttgaaaaataattctccaaatactctcagctatcctacatgaatttgaacaggtagtttcttacgattcagtaaataaaactttcatcttagagtgttttggactcatggatgatttgaagtgtatttttaatatgcaagtaggttcaagttttatttaatttcttaaattgtaactgacttagtgtgaca

SEQ ID NO: 202924 - DNA, 6574 bp, Homo sapiens
  Payload ID: 20020
  Gene Name: zinc finger protein 556
  Uniprot ID: Q9HAH1
  ENST ID: ENST00000307635
  CDS Start-End: 88-1458
gagtgaccacaggtgtccccgtcgtgctcacctgcaccggctgcgaggagcagggagctcctcaaagagctcaggaacggacaggacatggacacagtggtctttgaagacgtggttgtggatttcacgctggaggagtgggccttgctgaatcctgctcagagaaaactctacagagatgtcatgctggagaccttcaagcacctggcctcagtagataatgaggctcagcttaaagccagtgggtctatttctcagcaggatacttctggagaaaaattatccctcaaacagaaaatagaaaagttcacaagaaagaatatatgggcctcccttttaggaaaaaattgggaagaacatagcgttaaagacaagcacaacaccaaggagagacatttgagcagaaatccaagggtggagagaccatgtaaaagcagtaaaggtaataaacgtggaagaaccttcagaaagactcgaaattgtaatcgtcatctgcgcaagaattgttgtactagtgtaagacggtacgaatgcagtcagtgtggaaaactcttcacccattcctcatccctgataaggcacaaaagagctcactctggacaaaaattatataaatgtaaggaatgtgggaaagccttcagtcgcccttcctacctacagacgcatgagaaaactcacagtggagagaaaccctatgcctgtcaatcttgcgggaagacatttcttcgttcccactctctcactgaacatgtaaggactcacactggagagaaaccctacgaatgtgggcagtgtgggaaaggcttcagttgtcccaaatcctttcgcgcacatgtgatgatgcacgccggagggagaccgtatgagtgcaagcactgtgggaaagccttcaggtgtcagaaatcctttcgagtccatatgatcatgcacgccggagggagaccgtatgagtgcaagcagtgtgggaaagcctactgctgggcaacatcctttcaacgacacgtgagaattcacaacggggagaaaccctataagtgtggaaaatgcgggaaagcattcggttggccctcatccttacacaaacacgcgagaacgcatgctaaaaagaaacctgtgagtgggggcagcgtgggaaagtcttccgcgaggcctcgcccctccacagatgtcaaatcacaaactagagagaaagtctataaatgtgaaacgtgtgggaaaacgtatggttggtcctcatctttacacaaacatgagagaaagcacactggggagaaacctgtaaatgcagccagtgtgggaaaaccttcaggcgggctttgctcttccaaaaatgtaagaacgcagattggacagaagcccagtaaatgcgaaaaatgtgggaaagctttcagttgtcccaaagcctttcaaggtcatgtgagaagtcacacaggaaagaaatcctgtacatctaagtaatgggggaaaacctgtgcaaattaattcacatacatggttcagaaaattcacagcaggagggccgggcgcagtggctcacgcctgtaatcccagcactttgggaggccgaggcaggcggatcacgaggtcaggagatcaagaccatcctggctatggtgaaaccccgtctctactaaaaaaaaaaaaaatacaaaaaattagccgggcgtggtggcgggcacctgtagtcccagctgctcaggaggctgaggcaggagaacggcgtgaacccgggaggcggagcttgcagtgagccgagatggcaccactgcactccagcctgggtgacagagcgagactccatctccaaaaaaagaaaattcatggcaggagaagaatctcatgacgtttataaatatggtattgcctttatcaggaccacatcctaaaagtgggcctctagcaaatgaatttgcagttctcttgcaggtaaagttgaggggagaatcctgtaagtcctctctcacctatagtactgaaattttgatacataatggttttttcttataaattactaatgtttctcttttcatttagaagtgtattgcacccatgggtgatctgatgtattttaatatgcattaactttaatttttatatattttttttgttactccgtgtgaggccattagaccaatgaaatatgggtgtttgttgacattttctgactggccctgtgtgttccaagctggatattactaccatgttacttttattccacctttccattttacagggaaaaactatttttaatgttaatactttctacttatacaggcaagtaattcagtggctttatgctattggtcagagaatccttcttcattttgcttgtggactaataggtagttggtagaaatacgtatgcatgcaaattcttggaggagtgtagtctcgtgggaactatttttttcatctgttgctgtttgctctttgacctggcttctgggttggaattggaaaataggtttttttgggttttttttctttttcttttttgagacagagtcctgttatgttgcccaagctggagtgcaacggcacgatctcggctcactgcaacttccgcctcccggtttcaagcgattctcctgcctcagcctcccaagtagctgggactataggcatgcaccaccatgtccagctaatttttgtatttttagtagagacggggtttcaccatgttggccagggtggtctcaaactcctgaaatctgcccgccttggcctcccaaagtgctgggattacaggtgtgagccactatgcctggccatattatcattatcttaatacctcattgtctcagtatttcttgtgcttctgtgttcctgcttccatgacagatacaatggtacaaccataaaaacacaggggattgcggctgggcgcggtgactcacgcctgtaatcccagcactttgggaggctgaggtgggcggatcacgaggtcaggaaatcgagaccatcctggctatcatggtgaaaccccgtctctactaaaaatacaaaaaattagccaggtgtggtggcgggcgcctgtagtcccagctactcgggaggctgaggcaggaggatggcgtgaacctgggaggcgaagcttgcagtgagctggaatcgtgccactgtactccagcctgggcgaaagagcgagactctgtctcaaaaataaataaataaagaataattttttaaaaaagcacaggggattgtttccctactgcatctactgtgacctagtattcttcgtgagataaatcttacctttcatgagaaaatgaaagacaatactggcttatcaggtaaactctggaaatttcctgtcacatagagctgaatacaatctctcagtatgtgttcagttattatgtttgattatgtattattaaaacaaaagtttctgtttctgagaaatatctatttactgtgtttgtgtttttaaagaagttggattctatacaaatggataaaatgtttcttagaaatagcctatttaactgagtttttcaaataagttgtatactaacaaatgtcaatctctgttttttatttactgggagaatgtattaaaatattgaaaattgccaaatcaacatggtgactttaaaaatgatacttctgggccaggcacagtggctcacgcctgtaatcccagcactttggggaggccaaggcgggcagatcatgaggtcaagagatcgagaccatcctggctaacacggtgaaaccccatctctactaaaaatacaaaatattagtggggtgtgctggtaggtgcctgtagtcccagctactcgggaggctgaggaaggagaatggcttgaacctgggaggcggagcttgccaagattgcgacactgcactccagcctgggtgacagagcgagactccgtctcaaaaaaaagaattatacttctgaattaatattaccagatgcattcagatttagacattttctttctagtacatttgtttcctatactgttataattttgtctaagaaattcttttttttttttttgagacagattctcgctctgttacccaggctggagtgcagtgccgtgatcttggctcactgcaacccccccgccaaggttcaagtgattctcctacctcagcctcctgaagagctgggattacaggcacccgccaccacacccggctaatttttgtatttttagtagagacggggtttcactatgctggccaggctggtctcgatctcctgaccttgtgatctgcccacctcggcctcccaaagtgctggggttacaggcgtgagccaccgcgcccagcctaataaattcttgtttattcataatgacaaaaacttacgtaacggttttataaatttaagtattaaataagtctagcaaaagacataaaaagataactaataaaacaagtttaaactttattggagcccagtagcaatggctcacgcctgtaatcccaggacccaccgaggcgggtggatcacctgatgtgaggagttcgagaccacgctggccaacatggtgaacatggtgaaaccttgtctctactaaaaatacaaaaaattggccaggcgtggtggcaggcgcctgtaatcccagctacttgggaggctgaggcaggagaatcgcttgaacccgggaggcagaggttgcagtgagccaagattgcgccactgcactccagcctgggcgacaagagtaagactccatctcaaaaaaaaaaaaattttttttttggataatatcaaggcagaataaagtatagtatcaaacttgacaaggtagataatagggaatgcagaataaaggatcgggcttcagtaagtgacaatctcatcatgaattcatttatagttccaccatgtaatatgtcttaaatactatttctttttttttaatactatttcaagaactgctcatgagttaggaaatagtgagcagtaatacagaaataacggcaggaccaggggcagtggctcacacttgtaattccaaagcttcgggaggctgaggcaggaggatcacttgagcacaggagttcaaggccagtctgggcacatagtgagacacagtctctataaaaagaaatttttaaaagtatctaggcatggtgatgtgcacttgtagagccagctactcaggaggctgagggtggaggatggcttgagaccaagaggtccaggctgcaatgagttatcttgccactgtactccagccagggtgacagaatgagaccgtgtgtcaaattaaaaagaaaaaaagaaacaataattatttccctggccgggcgcggtggctcacgcctgtaatcccagcactttgggaggctgaggcgggtggatcacgaggtcaggagatcaagaccatcctggctaacccggtgaaaccctgtctctagtaaaaaatacaaaaaattagctgggcgtggtggcaggtgcctgtagtcccagctactcgggaggctgaggcaggagaatggcgtgaacccaggaggcggaacttgcagtgagcagagatcgaaccactacactccagcctgggcgactgagtgggactctgtctcaaaaaaaaaaagagacaaaaggtatatttatggttcagcctcatttctgcaaatattaaaaattttagggcatgatgtatacattttatatatatatatatatagtgtgtgtgtgtgtgtgtgtgtgtgtgtgtgtgtgaatgtgtgtgacggagttttgctctgttgccaggctggagtgcagtggtgcgatctcagctcactgcaacctccacctcccaggttcaagcgattctcctgcctcaccctcccaagtggctgggaatacaggcgtgccccgccacgcccagctaattttttgtatttttagtacaggtggggtttcaccttgttggccaggatggtctcgatctcttcacctcgtgatctgcccgccttggcctcccgcagagctgggattacaggcgtgagccaccgcaccaggcccatgtcatatgtttttatgagtttggacattggcatctgggaccaggtacttcatctggatttgaaccacaatgtgggtgtttgtttttaatacctttgtgaaataattttaaattgccttatatatttggcattgtcactttgctgcccctacacactgatggaaaaattgtgttctgcagaaaactagagttcctcacagggtgaggaagagttatggtcatctgcacagttgtagcccgttgcgagtgttttcccatgtgcacagtgatatctaggcaagtgtgccatgatttcctggtgaggataaaatctatggacggtgagagaactagtcaaggaataactgaagtgagctgcagacaggattatcattttgagtaacatcccaatgtatttgtcatcctttaattaatttttatttttttaattaaaaaataatttttaagtgtaaacctttaatgatccacaaagcccaaaatgtccatttgattttcataggtatcgtttccatatgcttagacttccagcagctattagaagagaaaaatatgtaacagctttgtgtttaattaaaggcaaatgaaatcca

SEQ ID NO: 202925 - DNA, 567 bp, Homo sapiens
  Payload ID: 20020
  Gene Name: zinc finger protein 556
  ENST ID: ENST00000586470
  CDS Start-End: 88-297
gagtgaccacaggtgtccccgtcgtgctcacctgcaccggctgcgaggagcagggagctcctcaaagagctcaggaacggacaggacatggacacagtggtctttgaagacgtggttgtggatttcacgctggaggagtgggccttgctgaatcctgctcagagaaaactctacagagatgtcatgctggagaccttcaagcacctggcctcaataatgaggctcagcttaaagccagtgggtctatttctcagcaggatacttctggagaaaaattatccctcaaacagaaaatagaaaagttcacaagaaagaatatatgggcctcccttttaggaaaaaattgggaagaacatagcgttaaagacaagcacaacaccaaggagagacatttgagcagaaatccaagggtggagagaccatgtaaaagcagtaaaggtaataaacgtggaagaaccttcagaaagactcgaaattgtaatcgtcatctgcgcaagaattgttgtactagtgtaagacggtacgaatgcagtcagtgtggaaaactcttcacccattcctcatccc

SEQ ID NO: 202926 - DNA, 1643 bp, Homo sapiens
  Payload ID: 20020
  Gene Name: zinc finger protein 556
  ENST ID: ENST00000586426
  CDS Start-End: 88-1455
gagtgaccacaggtgtccccgtcgtgctcacctgcaccggctgcgaggagcagggagctcctcaaagagctcaggaacggacaggacatggacacagtggtctttgaagacgtggttgtggatttcacgctggaggagtgggccttgctgaatcctgctcagagaaaactctacagagatgtcatgctggagaccttcaagcacctggcctcagtagataatgaggctcagcttaaagccagtgggtctatttctcagcaggatacttctggagaaaaattatccctcaaacagaaaatagaaaagttcacaagaaagaatatatgggcctcccttttaggaaaaaattgggaagaacatagcgttaaagacaagcacaacaccaaggagagacatttgagaaatccaagggtggagagaccatgtaaaagcagtaaaggtaataaacgtggaagaaccttcagaaagactcgaaattgtaatcgtcatctgcgcaagaattgttgtactagtgtaagacggtacgaatgcagtcagtgtggaaaactcttcacccattcctcatccctgataaggcacaaaagagctcactctggacaaaaattatataaatgtaaggaatgtgggaaagccttcagtcgcccttcctacctacagacgcatgagaaaactcacagtggagagaaaccctatgcctgtcaatcttgcgggaagacatttcttcgttcccactctctcactgaacatgtaaggactcacactggagagaaaccctacgaatgtgggcagtgtgggaaaggcttcagttgtcccaaatcctttcgcgcacatgtgatgatgcacgccggagggagaccgtatgagtgcaagcactgtgggaaagccttcaggtgtcagaaatcctttcgagtccatatgatcatgcacgccggagggagaccgtatgagtgcaagcagtgtgggaaagcctactgctgggcaacatcctttcaacgacacgtgagaattcacaacggggagaaaccctataagtgtggaaaatgcgggaaagcattcggttggccctcatccttacacaaacacgcgagaacgcatgctaaaaagaaacctgtgagtgggggcagcgtgggaaagtcttccgcgaggcctcgcccctccacagatgtcaaatcacaaactagagagaaagtctataaatgtgaaacgtgtgggaaaacgtatggttggtcctcatctttacacaaacatgagagaaagcacactggggagaaacctgtaaatgcagccagtgtgggaaaaccttcaggcgggctttgctcttccaaaaatgtaagaacgcagattggacagaagcccagtaaatgcgaaaaatgtgggaaagctttcagttgtcccaaagcctttcaaggtcatgtgagaagtcacacaggaaagaaatcctgtacatctaagtaatgggggaaaacctgtgcaaattaattcacatacatggttcagaaaattcacagcaggagggccgggcgcagtggctcacgcctgtaatcccagcactttgggaggccgaggcaggcggatcacgaggtcaggagatcaagaccatcctggctatggtgaaaccccgtctctactaaaaaaaaaaaaaa

SEQ ID NO: 202927 - DNA, 2268 bp, Homo sapiens
  Payload ID: 20021
  Gene Name: zinc finger protein 557
  Uniprot ID: Q8N988
  ENST ID: ENST00000252840
  CDS Start-End: 502-1794
agttccgcccccaaccctgccacagacccgcgccaggacgaccctgcctccgcggctgtccctagccagggcccaacctggttctattaataactaagcaaactagaacacctcagccggaggctggggtgcgcggctgctgcacctgcagcctgaacccgggggtcctgacacgccgcattttgggctgggaccagctggagccggaagcggaggtgcagtgtggctagccggagaccggaagcggaagcgcgcttgtgtcttgtgagaagagccgcgcttgcagcgtctgggagaatctttcggtctccgcgagaggtgcttcattccacgaaaaaagtataattcaagctcagatttgtgttgaaaccagcctcaagtttcacctatcctcactgatccgtggacttctgtatgatcagggtgctgtcctgagagcgctgcgggataaaggaggagcgtcctgcttcccggctgccctgttgctgtcggagtcacaggatggcggctgtcgtcctgcccccaactgccgctctgtcttccctgttcccagcctctcagcgagaaggacacacagagggcggagagctggttaatgagctcctgaaaagctggctaaagggcttggtgacctttgaggatgtggccgtggagttcacccaggaggagtgggcattgctggaccctgcccaaaggacactgtacagggacgtgatgctggagaactgcaggaacctggcctcactggggaaccaagttgataaacctaggctgatctcccagctggagcaagaagataaagtgatgacagaagagagaggaattctctcaggtacctgtccagatgtggagaatccatttaaagccaaagggttaactcctaagctgcatgtttttcgaaaagaacaatctagaaatatgaaaatggagaggaatcatcttggagcaacactcaacgaatgtaatcagtgttttaaagtcttcagcacaaaatcttcccttacacggcacaggaagattcatactggagaaagaccctatggctgcagtgaatgtgggaaatcctacagcagtagatcttaccttgctgttcataagagaatccacaatggggagaaaccctatgaatgcaatgactgtgggaaaaccttcagcagcagatcttaccttactgttcataagagaatccacaatggggagaaaccctacgaatgcagtgactgtgggaaaaccttcagcaattcctcatacctcagaccgcacttgagaattcacactggagaaaaaccgtacaaatgtaaccagtgttttcgtgagttccgcactcagtcaatcttcacaaggcacaagagagttcatacgggggagggtcattatgtatgtaatcagtgtggaaaggctttcggcacgaggtcatctctttcttcgcactatagcattcatacaggggagtacccttacgaatgccacgattgtgggagaaccttcaggaggaggtcgaatctgacacagcacataagaactcatactggagaaaaaccctacacatgtaatgagtgtgggaaatcctttaccaatagcttttctcttacaattcacaggagaatacataatggagagaaatcctatgagtgcagtgattgtggaaaatcctttaatgttctctcatccgttaagaaacacatgagaactcacactggaaaaaaaccctatgaatgtaattattgcgggaaatccttcacaagtaactcctacctttctgtgcatacgagaatgcataataggcaaatgtgaattcaataactgtgggaaaagcattcattgatctttcatgcctcagataacatgagcaaactctaacaagatgtatgaatcacctgctactgtgtaacaaattaccccccaaaattttgtggcttcaaacaaaaacacttgttatctcaaaatttttgtaggtcaggaattcagaaacaacatagctctatagttcttcaggatatctcaagaggttacagtccagatgtcagcagaactgtaatcatccagaattgttactggtgaagggaccacttccaaatggcttacaagcccgacaagtgcatgctagctgtttccaagggagctgcgcttccaaatcacgtaggcctctcaacagggctgagtttctttatggaagcaacttctccccaaagccagtgatctaaaggagccaacacagaaagcataatgtcttttatgacctagcttcagtgagatatgttttcatgt

SEQ ID NO: 202928 - DNA, 5736 bp, Homo sapiens
  Payload ID: 20021
  Gene Name: zinc finger protein 557
  Uniprot ID: Q8N988
  ENST ID: ENST00000414706
  CDS Start-End: 241-1512
cttgtgagaagagccgcgcttgcagcgtctgggagaatctttcggtctccgcgagaggtgcttcattccacgaaaaaagtataattcaagctcagatttgtgttgaaaccagcctcaagtttcacctatcctcactgatccgtggacttctgtatgatcagggtgctgtcctgagagcgctgcgggataaaggaggagcgtcctgcttcccggctgccctgttgctgtcggagtcacaggatggcggctgtcgtcctgcccccaactgccgcctctcagcgagaaggacacacagagggcggagagctggttaatgagctcctgaaaagctggctaaagggcttggtgacctttgaggatgtggccgtggagttcacccaggaggagtgggcattgctggaccctgcccaaaggacactgtacagggacgtgatgctggagaactgcaggaacctggcctcactggggaaccaagttgataaacctaggctgatctcccagctggagcaagaagataaagtgatgacagaagagagaggaattctctcaggtacctgtccagatgtggagaatccatttaaagccaaagggttaactcctaagctgcatgtttttcgaaaagaacaatctagaaatatgaaaatggagaggaatcatcttggagcaacactcaacgaatgtaatcagtgttttaaagtcttcagcacaaaatcttcccttacacggcacaggaagattcatactggagaaagaccctatggctgcagtgaatgtgggaaatcctacagcagtagatcttaccttgctgttcataagagaatccacaatggggagaaaccctatgaatgcaatgactgtgggaaaaccttcagcagcagatcttaccttactgttcataagagaatccacaatggggagaaaccctacgaatgcagtgactgtgggaaaaccttcagcaattcctcatacctcagaccgcacttgagaattcacactggagaaaaaccgtacaaatgtaaccagtgttttcgtgagttccgcactcagtcaatcttcacaaggcacaagagagttcatacgggggagggtcattatgtatgtaatcagtgtggaaaggctttcggcacgaggtcatctctttcttcgcactatagcattcatacaggggagtacccttacgaatgccacgattgtgggagaaccttcaggaggaggtcgaatctgacacagcacataagaactcatactggagaaaaaccctacacatgtaatgagtgtgggaaatcctttaccaatagcttttctcttacaattcacaggagaatacataatggagagaaatcctatgagtgcagtgattgtggaaaatcctttaatgttctctcatccgttaagaaacacatgagaactcacactggaaaaaaaccctatgaatgtaattattgcgggaaatccttcacaagtaactcctacctttctgtgcatacgagaatgcataataggcaaatgtgaattcaataactgtgggaaaagcattcattgatctttcatgcctcagataacatgagcaaactctaacaagatgtatgaatcacctgctactgtgtaacaaattaccccccaaaattttgtggcttcaaacaaaaacacttgttatctcaaaatttttgtaggtcaggaattcagaaacaacatagctctatagttcttcaggatatctcaagaggttacagtccagatgtcagcagaactgtaatcatccagaattgttactggtgaagggaccacttccaaatggcttacaagcccgacaagtgcatgctagctgtttccaagggagctgcgcttccaaatcacgtaggcctctcaacagggctgagtttctttatggaagcaacttctccccaaagccagtgatctaaaggagccaacacagaaagcataatgtcttttatgacctagcttcagtgagatatgttttcatgtccctgttacattggtcatacacaccaatcctgatacaatgtggaagaacaccacaggaggtatgaacagtagacatttggaaccatctggaaaacttgccatgaaatcagtggaggaaagccttcagctgaccctcatttttttttttttaagacaatgtctcactctgtcacccagtctggagcgcagtggtgtgatcacagctcactgcagcctctacttcctgggatcaagtaattctcctgccccagcctccaatgtagctgggactacaggtgcatgacaccatgtctggctaatttgtttttttttaaactagagggagggttttgccatgttgcccagactagtctcaaactcctaggttcaagcagtcctttcatcttggcctccagaagtactgggattacaggcatgaaccaccatgcccagccaacttctaaactgatcaatatgggagtagcattcaatcacccacaggttaactcactctagagagaaatcttgtgagtgtaatctgtatggtaaaactttgagctcaaactttccccctaccaaaaaaaaagtatctactggggagctgcccaggtaatgcagtagctgtaggaaagccttcagtgatggcttcagggagtcacatgacaactcacaataaggggaaaccctgtgtgtggcatcaaaaatggaaaaccaggggacactcattccttaagtcacatttcggagatcatacaacagaggaatatgttgagtatacacagtgttgaaaagcctgtgacacaaacagtcatattaccaagcacaagacagtatagtttggtatgctataaaagccttgaatattctctccatttttaagaagtgagattcatactagaaaaaccattgaattccatcagtattagaatgtcatttttccacatttttaggaacctaactcagtgtaagataacaatttatacaatttattttttgagacagggtttcatctgtgcccaggctgtagtgcagtggtgcaatcttggcttattgtaacctctgcctcccaggcttaagggatcctcccacctcagcctcccaagtagctgggactgtaggcatgcaccaccatgcctgtctagtttttgtaaagatggggattcaccatgtttcccaggctgctctcaaactcctgggctcaagtgatccacctgcctcagcctcccaaaatgctgggaatacaggaacgagctaccactctcagccagaacttcttaagataaaggatgagggaatgttttcagtgatacctcttatattaggaaaaatatgtaaatgttccttggatgcaatactcacgagtgtattaatttcagaaaaattttcagtgattcctccctttatgcatgagagaattcatttagaggaagccctaggaacgtaatcaatgttaggatgcctcatctcttaactgagtggccacgcagtaacttagaacaaaaggtgtaagtgctatgaatgtggaattaccttcatcaatgtctcatttgtaggttgggccactagctcgttcattttcagtcttttaatataaacatttatggctatagtggtcctgaaaatcttactacctcgttttatatacagtgtatttattataattctaaaacatcaatacaccaaatattcagaaaggtatttccaaacagctcctgagtgatctagtttgttataatagaaattagacatttgccaggtgtggtggctcacacctataaacctagcattttgggaggctgaggcgggcagatcaccggaggtaaggagcttgagaccagcctggccaacatggtgaaaccccgcttctactaaaaaatacaaaaattagccgggtgtggtggcaggcatctataatcccagctactcaagaggctgaggaaggagaatcacttgaacccgggaaatggaggttgcagtgagccaagatcatgccacttcactccagcctgggcaaaagagtgcaactctgtctcaaaaaaaaaaaaatcagacaatatttgatatatttttttctaatttaatagtattttgccagagtacatggactttgtgattttggttgttttctctttgtgtcctaatatagcaaatactgtttctttttttttttttttttttttttgagacggagtcttgctctgttgtccaggctagaatgcagtggcgcgattgtggctcactgcaagctctgcctcccagattcacgccatcctcctgcctcagcctcccgagtagctgggactacaggtgcccatcaccatgcccggctaatttttcatatttttagtagaaatggggtttcactgtgttagccagtatggtctcaatctcctgacctcgtgatccacctgcctcggcctcccaaagcactgggattacaggcgtgagccaccatgcccggcacaaatactgtttcttaatgttcattctccctacttaaagaaaaagataagttgtcaatgagcagtattgaaaatgtacagtggggccaggcgccatggctcatgcctgtaatcccagcactttgggaggccgaggcaggcggaccacctgaggtcaggagttcaagactagcttggccaacgtggtgaaacctcgtctctactaaaaaaaatacaaaaattagctgggcgtgatgacaggtgcctgtaatcccagctacttgggaggctgaggcaggagaatcgcttgagcctgggaagcggaggttgcagtgagccgagattgcacaaccacactccagcttgggcgacagagtgagactccatctcaaaaaaagatgtacagtgtactaggctttcctgaagcttagacaggctttatcccactctgctggctaaaagaagtaggaataacgcactgggtgagacaccgtctggcttattctcatctattttcttttcattcttttggaaagtggacacaaagcatagagttaaaagagcttttttttttttttttttttttttcttcactgtggtgataaaaaccacagtgcaggggctgggcgtggtggctcacgcctgtaatcccaccactttgggaggccaaggcaggcggatcacctgaggtggggagttcgagaccagcctgatcaacatggagaaaacctgtctctcctaaaaatacaaaattaaccgagcatgttggcgcatgcctgtaatctcagctacttggaaggctgaggcaggagaattgcttcaaactgggcagaggttgcagtgagccaaggttgacccactgcactccagcctgggcaacaagagcaaaactccatctcaaaaaaaaaaaaaaagaaagaaacagtgccgaaaaatcacaatgatttgagttcttcaaaaacctttgattggctgcattggctctgttctgcatattactagacttcttacatgatcacaagtaaccactaattggttaaaaccaaagagagagagagagagagtgtgtgtgtgtgtgtgtgtgtttggttggggggtgttgtgttagcttccaggtgaatgcattatctgttaatcctgtttattgatctgtttttataagtgctccatgattctctgaaaacagtatactatgtatctaatttttggatacaggatggacatacgtactcaaactgtgtttttcaatttgtactgtatttgtttctctcgacctgacttagtgatagaggtatattaaagtcttccactagcatggtagattaacaaa

SEQ ID NO: 202929 - DNA, 3014 bp, Homo sapiens
  Payload ID: 20022
  Gene Name: zinc finger protein 558
  Uniprot ID: Q96NG5
  ENST ID: ENST00000301475
  CDS Start-End: 231-1439
caggtggccctgaattcattgcctgctcagcaaaataaaggcccagtgtggaagccggaacttgcatttgaagaaggatgggaaggatgggttgaggagggcccatccccagcagcccgagagggaggaggccacggagacttggagcattcccgtttcttccagagcgctgcgggataaaggaggagcgtcctgcttcccggctgccctgttgctgtcggagtcacaggatggcggctgtcatcctgccctcgactgctgctccgtcttccctgttcccagcctctcagcaaaaaggacacacacagggcggagagctggttaatgagctcctgacaagctggctacggggcttggtaaccttcgaggatgtggccgtggagttcacccaggaggagtgggcgttgctggaccctgcccaaaggacactgtacagggatgtgatgctggagaactgcaggaacctggcctcactagggtgtcgtgttaataaacccagtctgatatcccagttggaacaagacaagaaggtggtgacagaggaaagaggaattctaccaagcacctgtccagatttggagactctacttaaagccaaatggttaactcctaagaagaatgttttcagaaaagaacagtctaaaggtgtaaaaacggaaagaagtcatcgtggagtgaaactcaatgaatgtaatcagtgttttaaagtcttcagcacgaaatctaacctaactcagcacaagagaattcatactggagaaaaaccctatgactgtagtcaatgtgggaagtccttcagtagcagatcttaccttactattcataagagaatccataatggggagaaaccctatgaatgcaatcactgtgggaaagcatttagtgatccctcatcccttagactgcatttgagaattcacactggagaaaaaccctatgaatgtaaccagtgttttcacgttttccgcaccagttgtaacctcaaaagccacaagaggattcacacgggggagaatcaccatgaatgtaatcagtgtggaaaagctttcagcacaaggtcctctctcactgggcacaatagcattcatacaggggagaaaccttatgaatgtcacgattgtgggaaaaccttcaggaagagctcctatctgacacagcacgtaagaactcatactggagaaaaaccctatgaatgtaacgagtgtgggaaatccttcagcagtagcttttctcttactgtgcacaagagaatacataccggagagaaaccctacgagtgcagtgactgtggaaaagcctttaataatctctcagctgtgaagaaacacttaagaactcacactggagaaaaaccctatgaatgtaatcattgtgggaaatccttcacaagtaactcctatctttctgtgcacaagagaatacataatagatggatatgaattactgcaggaacttctggaggaaagcactcattgatctttcatccctaagatagtttgagagagctcacactggatatataagttatttgttgcagcataacaaatgatccccgcaaattttgtggcttcaaacacgaaatgtttattctctaacaatttctacagatcaggaattcaagaacagcttatctctgtagttacactgcaggatctctcatgcctttacttacaatcaagatgtcagccaaagctatagtcatctaacatctttactgatgaacagtccacttccaagatgacttattcacatgcctggaaagttgatgttggttgttgtcaggggaccttcagtcattaccatgtaggcctctttacaaggcccagctccttgacaatttggcaataagttctcgccaaggttagtgatccaagagaggaccaatacagaggccaaaatggcttttatgacctatcctcaggaggactgctaagctttcacttatttcctattgtgttggtctcacaacacaccaatcctgatacaatgtgagagactgcagaaggtatgaataccaggaaacagataactcagaagcatctgggaaatttgccatggaattaatgaagaaaagccctcagcacatcatccttctactctaatcaatatgaaatagcattcagtaactcctattaattcactctgaagagaaaccttttgaggacaatctgtatggtaaagctctcagctcgaattctcaccttcatgggcccagaagattatgtactgagagaatcctgaagaatggaacagctgtagaaagccttcagtgctatcagcagggattcatgtgacagctcacactaagggagaaaacctgtgaaggtctcagaaggcttcagtgacagtcatcccttaagacgcactggaaatcacacaatggaacaacactcagaaatgcggaataccctacagcaaaagtgttcacattactgagcaaactatagtgtggtattctgcagtgactatgggaaagccttgaatgttctatcggtttttaagggacttgagaattaattctggagagaatgccccattgaacatcatcaatattggagagctttctgtttttctacatttgttaggaaacttgtgagcattcacactacagagaaacttgaaatataaagaagaagagaaagccttcagtgatgcctctgtgttagggaaaatatggaacttctccctggatgcaaaacctatgagtatattaatattggaaaatttttcagtgattcttctctttcttgtatatgagagaacttatatggagaaacccctaggaatgtaatcagtgttaggatgcctcagcctgaactcttcactgagtggccacaattttcactgggaacaaaaagtataatcactgttttgagtgtgggatatcctttatcagtgtctcatctgtagattggactgctggctcattaatttttttagtctttttttcttttaatataaacatttgtgtatagctgttccctaaaataaacattaacatatttcataatttt

SEQ ID NO: 202930 - DNA, 7032 bp, Homo sapiens
  Payload ID: 20022
  Gene Name: zinc finger protein 558
  Uniprot ID: Q96NG5
  ENST ID: ENST00000601372
  CDS Start-End: 713-1921
agaccggaagcggaagcgcggggcggtaccgtgggaggggccgcgcgtggggcagcggggagcgagtccctccgtccccgcgagtcggcgcttttggccccgcgggaggggccgggctcgatgagaaaagcatcattcaagctcagattcgtgttgaagcctgccacaaggtccacctgttgttgtgggtttttgggtgaccaggggttacccccagcagtgtgtgagaatgaagagtgtgggccactgtgtctctgttgacctgccagataggaaatagcgccagagttgctgcaatccacgtctccctggaattcaggagcagcttggctggaaggctctggctggaaacttgcagaaggctgtcagctgggtctgcatcatctgaaggctcaacgggtaccgggggccactccatggcctgcgagtcagagctggccgtcggtgggaggcctcagttcctctccacataggcctctccacagggccacttgagcgtcttcccaccatggcaactggtgtcctctagagcaacatccaggagaccaaggcggaagcagctgtagtgccttccaagacctggtcctgaaagtcacccctgcacccacccccgctgtctcctcagccatattctgctggtcacacagagcgctgcgggataaaggaggagcgtcctgcttcccggctgccctgttgctgtcggagtcacaggatggcggctgtcatcctgccctcgactgctgctccgtcttccctgttcccagcctctcagcaaaaaggacacacacagggcggagagctggttaatgagctcctgacaagctggctacggggcttggtaaccttcgaggatgtggccgtggagttcacccaggaggagtgggcgttgctggaccctgcccaaaggacactgtacagggatgtgatgctggagaactgcaggaacctggcctcactagggtgtcgtgttaataaacccagtctgatatcccagttggaacaagacaagaaggtggtgacagaggaaagaggaattctaccaagcacctgtccagatttggagactctacttaaagccaaatggttaactcctaagaagaatgttttcagaaaagaacagtctaaaggtgtaaaaacggaaagaagtcatcgtggagtgaaactcaatgaatgtaatcagtgttttaaagtcttcagcacgaaatctaacctaactcagcacaagagaattcatactggagaaaaaccctatgactgtagtcaatgtgggaagtccttcagtagcagatcttaccttactattcataagagaatccataatggggagaaaccctatgaatgcaatcactgtgggaaagcatttagtgatccctcatcccttagactgcatttgagaattcacactggagaaaaaccctatgaatgtaaccagtgttttcacgttttccgcaccagttgtaacctcaaaagccacaagaggattcacacgggggagaatcaccatgaatgtaatcagtgtggaaaagctttcagcacaaggtcctctctcactgggcacaatagcattcatacaggggagaaaccttatgaatgtcacgattgtgggaaaaccttcaggaagagctcctatctgacacagcacgtaagaactcatactggagaaaaaccctatgaatgtaacgagtgtgggaaatccttcagcagtagcttttctcttactgtgcacaagagaatacataccggagagaaaccctacgagtgcagtgactgtggaaaagcctttaataatctctcagctgtgaagaaacacttaagaactcacactggagaaaaaccctatgaatgtaatcattgtgggaaatccttcacaagtaactcctatctttctgtgcacaagagaatacataatagatggatatgaattactgcaggaacttctggaggaaagcactcattgatctttcatccctaagatagtttgagagagctcacactggatatataagttatttgttgcagcataacaaatgatccccgcaaattttgtggcttcaaacacgaaatgtttattctctaacaatttctacagatcaggaattcaagaacagcttatctctgtagttacactgcaggatctctcatgcctttacttacaatcaagatgtcagccaaagctatagtcatctaacatctttactgatgaacagtccacttccaagatgacttattcacatgcctggaaagttgatgttggttgttgtcaggggaccttcagtcattaccatgtaggcctctttacaaggcccagctccttgacaatttggcaataagttctcgccaaggttagtgatccaagagaggaccaatacagaggccaaaatggcttttatgacctatcctcaggaggactgctaagctttcacttatttcctattgtgttggtctcacaacacaccaatcctgatacaatgtgagagactgcagaaggtatgaataccaggaaacagataactcagaagcatctgggaaatttgccatggaattaatgaagaaaagccctcagcacatcatccttctactctaatcaatatgaaatagcattcagtaactcctattaattcactctgaagagaaaccttttgaggacaatctgtatggtaaagctctcagctcgaattctcaccttcatgggcccagaagattatgtactgagagaatcctgaagaatggaacagctgtagaaagccttcagtgctatcagcagggattcatgtgacagctcacactaagggagaaaacctgtgaaggtctcagaaggcttcagtgacagtcatcccttaagacgcactggaaatcacacaatggaacaacactcagaaatgcggaataccctacagcaaaagtgttcacattactgagcaaactatagtgtggtattctgcagtgactatgggaaagccttgaatgttctatcggtttttaagggacttgagaattaattctggagagaatgccccattgaacatcatcaatattggagagctttctgtttttctacatttgttaggaaacttgtgagcattcacactacagagaaacttgaaatataaagaagaagagaaagccttcagtgatgcctctgtgttagggaaaatatggaacttctccctggatgcaaaacctatgagtatattaatattggaaaatttttcagtgattcttctctttcttgtatatgagagaacttatatggagaaacccctaggaatgtaatcagtgttaggatgcctcagcctgaactcttcactgagtggccacaattttcactgggaacaaaaagtataatcactgttttgagtgtgggatatcctttatcagtgtctcatctgtagattggactgctggctcattaatttttttagtctttttttcttttaatataaacatttgtgtatagctgttccctaaaataaacattaacatatttcataattttaatgcaatgtatttattataattaatttgcttgttaaagacatccacacattgcatattcaaaaagttatttccaaataccttctgagtgattcagtttatcataatggaaattagtatttataaacacatttttctaatgtagtggtatttttggcagagtacatgagctttatgatactgattattttctctctatcttggtatgccaaatactgttggtttctttcccagtgtccgttctcttcagtttattcgtttaaagaaacaaacatgttgttcaagttgtctgtgaacaatatcgaaagttctcaatcttatagtttttcctgaagcccaggcgggttttttcgcactcccctggcaatgagaagtaagtcgaagtcactgtgtggaacatctcctggcttgttctcctcacatattttccattcacctcacccattctgtctcttggaaagtggcctcaaggtctagagtttgaagagcttctttttgaccacaatgacagaaaccaaagtgcagccaaaaatcacaatgctttgggctctccaggagcctccgattggctgcatctgctctggactccttattcttatacttcttatgtgactaaaagaaacccctaggctgggtgtggtggctcacgcctttaatcccagcacttttgagaggctgaggtgggtggatcatgaggtcaacagattgagaccatcctggccaacgtggtgaaaccctatctctactaaaagtataaagattagctgggtgtggtggtgcacacctgtattcccagctactcgggaaactgagacaggagaattgcctgaacctgggaggtagaggttgcagtgagccaagatggcgccagtgcactccagcctggcaacagagcgagactccatctcaaaataaacaaataaatatttttaaaaaaagaaacccctaactgattgaagccaacatgatctgttgtttgtttttgaggtggtgttctgttaacttccagcaggatgcagaatctaactggtaaacctataaattggtcaagttttacccatgttgtttctttgaaaacaatgtatattctctaatatttggatatagggtatatgaacattaatgcaacttaattgtatttccaagtacagtacgtatgttcagatttctttttctaaccttatttagtgatagaggtgtggtaaactcttccattatgtttatgtattaacactgtaattttgtcatttttatatattttgacattatgtaactagatgcatacaggattaggtattctgtattcctttttatgtggagatgatatttttacatagcaaagtattgtaatgcattaataataaatggtcaaacatttatttatttatttatttattttagatggagtttcactcttgtcatcaagggtggagtgcaatggtgcgatctcggctcactgcaaccttggcctcccaggttccagcaattctcctgcctcagcctcctgagtagctgggattacaggcacctgccaccacgcccaggtaatttttttatatttttagtagagatggggtttcaccatgttggccaggctagtctcgaactcctgatggtcagacatttatattgcacttcccatagatcaggcccccttctaaatgacatataagtattaactcagtatgcattataaacttaagtatgtaatgttattatccccagtttacagatgagaaaactggtatgatacacttaagttacttgcctgcattcactgactggtaaatggtagagccaagatctgaacccagacagtccatgcacttaaccactaccctattaacggagtatgttctgtgtgccaggcaaagttttgccattgaaatacttcacctaatggaggaggaacagattatagaaaaatcaagaaaatatggtattatagagttataggaaaaaaaagcattttaggagagttaaggggggttgggaataataattttatataactaggaaaagaaagcctcttggtaaggagcatttgagcggagatctcaacaagttgggacagtgagtcatatgaatttgtcttgcaagagtagtgttggcatgcaaaggcccacaacaaggaggccaatacagctggagtggaacaaaggggtgatgagggagcagtaaaagatgatgtggtcagagacatggtagatcctgatcttgttgggttttctgagacattgttaggacttttccttatttcagtgagttggcacatcagtcagggtcccagcaggaactcaggttgacacccacagactaggacaattcaagtagagttttcataaagggtctactcagtcctgtggacaggatccagggaaaccacaaaaagttgtaaagcacccagcagcttagcagggcagagctctaacacctcacagcctgaagggacgaagggagggagcaactgaatctggagacgagaggagagggctgcattccaggagctgagagaggtcagtcagcgatagcatccagccccaggtcctcctgcaggaaatagccagggtcagacctcactctccttcatccattgagacaggaaaatatccccatttatgaatatataaatcaatagcagatccagagacaatttgggtattggagttagcagacaaagactttaaaataaccaagaataatatgttaagggaaatggaggaaacatggacaaaccatagaaaatgagagacaaactgcaaatctaccaaacaaccaaagaagaaggacacattgctttcaaagcagcatcagtaagactaatgatgacttttcaaaagaaactatggaagcaagaagacaatgaatgacatctgacatataaagggttaaatgggttggaggagggggaaattgtcaatcaaaagttctgtaacctaagaaaatattcttcaaaactgaaggcaacaatgttttccaatgggagggaatatttttttttttttttttgagatggagtctcactctgtcgccatgctggagtgcagtggcatgatctcggctcactgcaacctcctcctcctgggttcaagtgattctcctgcctcagcctcctgagtagctgggactacaggtgtgtgctaccacgcccagctaatttttgtatttttagtggagacagggtttcaccatgttggccaggatggtctcgatcctttgacctcacatgatttgcccacctcggtctcccaaagtgctgggattacaggcgtgagccaccacgcccggcctgggagggatttttttaagctgagagaattaacagcataaccgtattttcagaaacactgaagagatttcttcaggcttcaggaaaatgattccatagagacatacataattccaggaattaagatcaacaggaaacataagatgcaagtaaatataaatcagtactgactgtataaaacaaccctgtatagttttacaacttttatgtatatctaaactttccaaaataaaatgcttttaaaaaca

SEQ ID NO: 202931 - DNA, 2732 bp, Homo sapiens
  Payload ID: 20023
  Gene Name: zinc finger protein 559
  Uniprot ID: Q9BR84
  ENST ID: ENST00000317221
  CDS Start-End: 263-517
atgcgcataacggccgccatcttaacagcgcgttcccgttggcgtctgaggaacagcatctctgccttcctgttcacggtgaccttcgcttggtgtcctcctggcctcagcaacctgacaattctgtcgtgtcccgagagatggctaatgaatggcgcttgatgacagatgagtaatgcctgttgctgaaagattgacggtatgagatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatgaattcagagtaaaagggagaatctcaatgaaataaatttggaaaacttctatgaaccatcattaattttcaccaacaggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctg

SEQ ID NO: 202932 - DNA, 5095 bp, Homo sapiens
  Payload ID: 20023
  Gene Name: zinc finger protein 559
  Uniprot ID: Q9BR84
  ENST ID: ENST00000393883
  CDS Start-End: 649-2265
gttcggtggtgtcccggtgcagccacgcgagagtagaagggtggaaaggggaggtgcccagtgaaatggagcctgtcccgtgcactttcgggcatttcgagcatcttgtgggctctcccaagtcgcggcccctcctctgagagccacagtcaggtctgtcctcaggggtcgaggcggctgcgctggggcctcggcccgggaggaggcggggggcacggcctttccattttccctgctcccctctgcagaagcctcatagggcccggcgcggcggctcacgcctgtcattcccagcgctttgggcggattgggtaggaggattacttgaggccaggagttcaagaccaggcagggcaacatagggagacccccccccccaaccatctctaatggaaaaaaaaaaaaaagtctccacatccagcgttgtgccttttctctataaggaacagcatctctgccttcctgttcacggtgaccttcgcttggtgtcctcctggcctcagcaacctgacaattctgtcgtgtcccgagagatggctaatgaatggcgcttgatgacagatgagtaatgcctgttgctgaaagattgacgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctgaagatcctgagttatctcaattgttcacggttacagatggaactctttattattgaggagttccactctttcccccatttgtcactactacacttccctagtctttaaaacaattttaggctgggtgcagtggctcattcctgtaatcccagcactttgaaaggccgaagcgagtggatcatttgaggtcaggagttcgagaccagcctggccaacgtggtgaaaccccatctctactaaaaatacaaaaattagccaggcatggtggtacgtgcctgtaatcccagctactcgagaggttgaggcagaattgcttgaacccgggaggcggaagctgcagtgagctcagatcacgccactgcactccagcctggatgatatggtaagaccatctcaaaaaaagaaaaaaaaattaaaatatcctcagagggttttttaatgaaaaacttagttatagggaattgaggaacatttaggggtacaaattttcacttattgcacacaagaaaattggtactggccaggcatgctggctcacaccttaattccagcaatttgggaggccaaggcagaaggatcacttgagcccaggagttcaagaccagcctgggcaatatagtgaaacctcatcttgacaaagaataaataagattaactgggtgtactggtttgtgcctatagtcccagctatttaggaggctggggcaagaggattgcttgagcctggtcagggaggcagaggttgcagtgagccctgatcgtgccactacactctagcctgggcaacaggatgagaccctgtctcaaaaaaaaaagaaaattgacgccagcaaagaaaaccaaataaattatttaagtttgcctttctatatgtctttaaagactaatgatattgaacatcactttcatatgcttatgagtctttggtgaagtgtacatttaatgatcttttttcactgttgctgagaatctttggtttgaattattgaggcaggttctttcagtaagtttgagatataattgccatgtaataaactgcacatgtttttagcatacactttaagtttggacacatacacatatgtgtacatacacaccatcaagataatgaacatacctatcaaaccagatggtttcctcatgcccttttataatttcttcttctcctcacccttccctgcctgtcactctcctgatccactgatttgctttctcttagaatagacgactttatattatgtacagtttttatataaatggaatcatatagtctggcatctttcaggataattttttcagatccatttatgttgtagggtccatttcactgctgaatagtattccattgcaaggcataccacaagctatttatccatgtgttatttctaccttttggctattgcaattaaaactgccttgaatacccatatgcagattattctttaaacatgtgcttctgtttctttaaatagttaagagtggaatgatcagatcatatgttagtgtacgtttaagtttttaagagactgctaaacctttctcaagtagttatgccatttgacatttccatgagcagtatataagagttgcaattcttctgcatccttgccaattattggtatggtcagtcttttttattttgaccattttaataggtgtgtagtagtatctcatggttttaatttgcatttccctagtgactaatgatgtcttacatggtttcacgtgcttactggccttctttaagcctttggggaagagtctgttcaaatcttttgcctgtttatattggctttattttttatttatttttatttttttttatatagagacagggttttactctgtctcccaggctgaagtgcgtggcacgatcatgtggttttgcaatatttattgaattttgagagtttaaaatttgtaatatatttaatattaaacctattagtgtatttgatattaatactttatatttaatataatgtacatttaaatatataataaaacatttcattttaacagaggtaacataaatacacttcccaatttatggag

SEQ ID NO: 202933 - DNA, 571 bp, Homo sapiens
  Payload ID: 20023
  Gene Name: zinc finger protein 559
  ENST ID: ENST00000585377
  CDS Start-End: 455-571
aagtttttgtttctgggcggcgttcggtggtgtcccggtgcagccacgcgagagtagaagggtggaaaggggaggtgcccagtgaaatggagcctgtcccgtgcactttcgggcatttcgagcatcttgtgggctctcccaagtcgcggcccctcctctgagagccacagtcaggaacagcatctctgccttcctgttcacggtgaccttcgcttggtgtcctcctggcctcagcaacctgacaattctgtcgtgtcccgagagatggctaatgaatggcgcttgatgacagatgagtaatgcctgttgctgaaagattgacggtatgaggcaagactcccactactacttaatcaagaggaattgagattgacttacccataagttcagacagtgtctcgaagagactttgggaacaagatattcaggcacatttcactgttagactcacaggatgctggccattggtctttccctttgtgatcatctttctcaagatgttttctgtcttcatgagtcaaaatttgaagaggaaaggatggtggctgggtggttgacaaattactctcag

SEQ ID NO: 202934 - DNA, 1016 bp, Homo sapiens
  Payload ID: 20023
  Gene Name: zinc finger protein 559
  ENST ID: ENST00000586255
  CDS Start-End: 331-780
atgcgcataacggccgccatcttaacagcgcgttcccgttggcgtctgaggaacagcatctctgccttcctgttcacggtgaccttcgcttggtgtcctcctggcctcagcaacctgacaattctgtcgtgtcccgagagatggctaatgaatggcgcttgatgacagatgagtaatgcctgttgctgaaagattgacggtatgaggcaagactcccactactacttaatcaagaggaattgagattgacttacccataagttcagacagtgtctcgaagagactttgggaacaagatattcaggcacatttcactgttagactcacaggatgctggccattggtctttccctttgtgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatgagtctcactgtatcacccagactggagtgcagtggtaccatctcagctcacggcagcttccacctcccaggttcaagcaattcttgtgcctcagcctcccgagtagctgggacttgtgcctgagcctcccaagtagctgagactataggtgcgtgccaccacagctggctaacttgtgtttgtagtagagacagggtttcaccatgttggccaggttggtttcaacctcttggcctcaagtgatccacccacctcagcctcccaaagtgctgggattacaggcgcgagccaccgcatctggcctgcggatactatacatttttgattatggtagctgtctagtaaatcttgaaagcaag

SEQ ID NO: 202935 - DNA, 801 bp, Homo sapiens
  Payload ID: 20023
  Gene Name: zinc finger protein 559
  ENST ID: ENST00000588124
  CDS Start-End: 559-801
gcccagtgaaatggagcctgtcccgtgcactttcgggcatttcgagcatcttgtgggctctcccaagtcgcggcccctcctctgagagccacagtcaggaacagcatctctgccttcctgttcacggtgaccttcgcttggtgtcctcctggcctcagcaacctgacaattctgtcgtgtcccggcaggagtacagtggtgagatcacggttcactgcagcattgacctccctaggctcaggtgttgctcccacctcagtcttctgaatagcttggagtataggtaaacgggatttgttattatttatgtccacgtggcataatactctagtggcactcacatgaacaacttcatcttctgcagagagatggctaatgaatggcgcttgatgacagatgagtaatgcctgttgctgaaagattgacggtatgaggcaagactcccactactacttaatcaagaggaattgagattgacttacccataagttcagacagtgtctcgaagagactttgggaacaagatattcaggcacatttcactgttagactcacaggatgctggccattggtctttccctttgtgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagta

SEQ ID NO: 202936 - DNA, 1488 bp, Homo sapiens
  Payload ID: 20023
  Gene Name: zinc finger protein 559
  ENST ID: ENST00000592896
  CDS Start-End: 313-651
atcttaacagcgcgttcccgttggcgtctgaggaacagcatctctgccttcctgttcacggtgaccttcgcttggtgtcctcctggcctcagcaacctgacaattctgtcgtgtcccgagagatggctaatgaatggcgcttgatgacagatgagtaatgcctgttgctgaaagattgacggtatgaggcaagactcccactactacttaatcaagaggaattgagattgacttacccataagttcagacagtgtctcgaagagactttgggaacaagatattcaggcacatttcactgttagactcacaggatgctggccattggtctttccctttgtgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatgaattcagagtaaaagggagaatctcaatgaaataaatttggaaaacttctatgaaccatcattaattttcaccaacaggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatca

SEQ ID NO: 202937 - DNA, 692 bp, Homo sapiens
  Payload ID: 20023
  Gene Name: zinc finger protein 559
  ENST ID: ENST00000591652
  CDS Start-End: 1-159
caaactcagagaaacttatacagagatgtgatgctggagaactataagaatctagttgcagtagattgggagagtcatattaataccaaatggtcagcacctcagcagaattttttgcaggggaaaacatccagtgtggtggaaatggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctgaa

SEQ ID NO: 202938 - DNA, 967 bp, Homo sapiens
  Payload ID: 20023
  Gene Name: zinc finger protein 559
  Uniprot ID: Q9BR84
  ENST ID: ENST00000585352
  CDS Start-End: 193-447
atgcgcataacggccgccatcttaacagcgcgttcccgttggcgtctgaggaacagcatctctgccttcctgttcacggtgaccttcgcttggtgtcctcctggcctcagcaacctgacaattctgtcgtgtcccgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatgaattcagagtaaaagggagaatctcaatgaaataaatttggaaaacttctatgaaccatcattaattttcaccaacaggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgc

SEQ ID NO: 202939 - DNA, 1398 bp, Homo sapiens
  Payload ID: 20023
  Gene Name: zinc finger protein 559
  ENST ID: ENST00000592504
  CDS Start-End: 256-783
atgcgcataacggccgccatcttaacagcgcgttcccgttggcgtctgaggaacagcatctctgccttcctgttcacggtgaccttcgcttggtgtcctcctggcctcagcaacctgacaattctgtcgtgtcccgagagatggctaatgaatggcgcttgatgacagatgagtaatgcctgttgctgaaagattgacgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatggtaagattcagaaggtataatttattgtcttccatgttagaggaagattggaaattccttaaaatggaaaagcagcacaataaccttgagacatttgagactagtgtttttcacccaaaaataatctgtctcttggagagactatggatcatgagtttgacaaacactctaaacatccctcagaatatatttgtttacatatttccttcaacattcccatatgtatctcagatgtttttgataaataattcactcttgggccgttatcagctaagctctatttagaagccctctgaaagtaaagaatataacagaacttcctgcagtcactttgttccacttgaaaacactcaggtctgaaccatgccttgcaatgaaaatggcaggaacaaacagtttcaattatactaacttattttccatgtgtaacagaattcagagtaaaagggagaatctcaatgaaataaatttggaaaacttctatgaaccatcattaattttcaccaacaggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagaga

SEQ ID NO: 202940 - DNA, 2991 bp, Homo sapiens
  Payload ID: 20023
  Gene Name: zinc finger protein 559
  ENST ID: ENST00000587557
  CDS Start-End: 408-2216
catttacaggaggtgagcatgaagtggccaatgggaaaattctaggaggtattgggactcatgaaggttctgtttcggagcccttgagctgccgcttggccagttcccacactgtggagtatgctttcgttttcaacaaatcccagctcttgttcttttgttgcttcattctttctttgctttgctgggcgttttgtctaattctttgttcaaaacgccagtaacctggacagcttgcagtcaagaccccctaccggtgacacttgcgctcttcggggaggtaaacagcatttcctctcagctctgggttggaaaaagccgcagcagctgatgggcccgggaacccgaggccccgccccctaggtggtcctagcctttgcgcgtgcgcggcgtgtctgcgtgggcgcatgcgcataacggccgccatcttaacagcgcgttcccgttggcgtctgaggaacagcatctctgccttcctgttcacggtgaccttcgcttggtgtcctcctggcctcagcaacctgacaattctgtcgtgtcccgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctg

SEQ ID NO: 202941 - DNA, 588 bp, Homo sapiens
  Payload ID: 20023
  Gene Name: zinc finger protein 559
  ENST ID: ENST00000592298
  CDS Start-End: 385-588
gaggtaagtttttgtttctgggcggcgttcggtggtgtcccggtgcagccacgcgagagtagaagggtggaaaggggaggtgcccagtgaaatggagcctgtcccgtgcactttcgggcatttcgagcatcttgtgggctctcccaagtcgcggcccctcctctgagagccacagtcaggaacagcatctctgccttcctgttcacggtgaccttcgcttggtgtcctcctggcctcagcaacctgacaattctgtcgtgtcccgagagatggctaatgaatggcgcttgatgacagatgagtaatgcctgttgctgaaagattgacgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcag

SEQ ID NO: 202942 - DNA, 569 bp, Homo sapiens
  Payload ID: 20023
  Gene Name: zinc finger protein 559
  ENST ID: ENST00000589208
  CDS Start-End: 127-569
gtctgaggtaagtttttgtttctgggcggcgttcggtggtgtcccgattgggagagtcatattaataccaaatggtcagcacctcagcagaattttttgcaggggaaaacatccagtgtggtggaaatggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccct

SEQ ID NO: 202943 - DNA, 2117 bp, Homo sapiens
  Payload ID: 20023
  Gene Name: zinc finger protein 559
  ENST ID: ENST00000605750
  CDS Start-End: 1-1575
atcttaacagcgcgttcccgttggcgtctgaggaacagcatctctgccttcctgttcacggtgaccttcgcttggtgtcctcctggcctcagcaacctgacaattctgtcgtgtcccgattgggagagtcatattaataccaaatggtcagcacctcagcagaattttttgcaggggaaaacatccagtgtggtggaaatggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtc

SEQ ID NO: 202944 - DNA, 3054 bp, Homo sapiens
  Payload ID: 20023
  Gene Name: zinc finger protein 559
  Uniprot ID: Q9BR84
  ENST ID: ENST00000603380
  CDS Start-End: 663-2279
catttacaggaggtgagcatgaagtggccaatgggaaaattctaggaggtattgggactcatgaaggttctgtttcggagcccttgagctgccgcttggccagttcccacactgtggagtatgctttcgttttcaacaaatcccagctcttgttcttttgttgcttcattctttctttgctttgctgggcgttttgtctaattctttgttcaaaacgccagtaacctggacagcttgcagtcaagaccccctaccggtgacacttgcgctcttcggggaggtaaacagcatttcctctcagctctgggttggaaaaagccgcagcagctgatgggcccgggaacccgaggccccgccccctaggtggtcctagcctttgcgcgtgcgcggcgtgtctgcgtgggcgcatgcgcataacggccgccatcttaacagcgcgttcccgttggcgtctgaggaacagcatctctgccttcctgttcacggtgaccttcgcttggtgtcctcctggcctcagcaacctgacaattctgtcgtgtcccgagagatggctaatgaatggcgcttgatgacagatgagtaatgcctgttgctgaaagattgacgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctg

SEQ ID NO: 202945 - DNA, 2654 bp, Homo sapiens
  Payload ID: 20024
  Gene Name: zinc finger protein 560
  Uniprot ID: Q96MR9
  ENST ID: ENST00000301480
  CDS Start-End: 215-2587
ttttggtcgctggcgcctgtttcctcagagccactttttcctttgtgttgtctggtcgttcactactttgagggaaaagaattttgccgttcgcgttcgattgactccgtccccaagatcctgtagccccacggacctggcgactccaccgtgttcgggtctttctaggaacccaatctgccttcatgaagaaaagacagaggcagaaaggaagatggcttactgcctgacaaattgttatcagtactccgtgacctttgaggatacagctgtggacttcacccaggaggagtggattttactggacccagttcagagaaacttatacagagatgtgatgctggagaattatgagaacgtggccaaagtaggatttcagctctttaaacccagtgtcatctcttggttggaagaagaagagttgagaaccttgcagcaaggagttctccaagactgggcaataaaacatcaaaccagtgtttcagcactgcagcaggagttttggaaaatacaaacttctaatgggatacaaatggacctggtaacctttgacagtgtggctgtggagttcacccaggaagagtggactttactggacccagctcagagaaacctgtacagtgatgtgatgctggagaactacaagaacctgtcctcagtaggttaccagctcttcaaacccagtctgatctcttggctggaggaagaggaagagttgagcacactgccaagagttctccaagaatggaaaatgtgcctgaaaaccaaagggccagccctttggcaagataatttttgtttaaaaacattaaatgggatacagttggcaagaaaccaaaatggagaggaactctatgactgtaagcaatgtgaagatgtcttctgtaaacatccatgccttaagaccaacatgagtactcaaaatagaggcaacacgtctgaatgtattcagtatgcaaaagacctcctttctctatacaataaaacctctaccataaggaaagtttctgtgttcagtaagcatggaaaatctttccgcctgattttaaatgttcaggtccagagaaagtgtacacaagataaatcctttgaaggcactgactatgggaaagccttcatttatcagtcataccttgaagcacacaggaaaactcagagtggagaaaaactcaatgaatggaagcaatgtggggaagcatttactcactccacaagccatgctgtaaatgttgaaacacacattattaaaaacccctatgaatgtaaggaatgtggaaaagattttagataccctacccaccttaataatcacatgcaaacccacattgggataaaaccttataaatgtaagcactgtggcaaaaccttcactgtgccgtcaggctttcttgaacatgtacgaactcacactggagagaagccctatgggtgtaaggaatgtggtaaagcctttggtacatctgcaggccttattgaacatataagatgtcacgccagagagaaaacctttaaatgtgaccactgtgggaaagcctttatttcttacccatctctttttggacatttgagagttcataatggagagaagccatatgagcataaggaatatgggaaggcctttggtacatcctcaggtgttattgaagatagaagaagtaacacaggacagaaacgctttgattgtgaccagtgtgggaaagtctttgtttctttctcatctctttttgctcatttgagaactcacactggtgagaagccctttaagtgttacaaatgtgggaaaccatttacctcttctgcctgtcttcgtattcacatgcgaactcacacagaagagagactctatcaatgtaagaaatgtggtaaagctttcactaagtgctcatatcttaccaaacatttacgaacacacgctggagagaaaccctatgaatgtatgaaatgtgggaaagccttcactgagcgctcataccttactaaacatttacgaagacacagtggagagaagccatatgaatgtaagaaatgtggaaaagccttcacagaacgctcagatcttactaaacatttacgaagacacactggagataagccctatgaatataaggactgtgggaaagcctttgttgtctcctccagtctagttgatcatttaagaactcacactggatataaaccctataaatgtaatgcatgtgaaaaagcttacagtaggtcttgtgtactaactcaacacttaaaaactcatgcagcagagaagacctctgaatgtaacgcatgtggaaattcctttcgaaattccatgtgctttcatgatcgcttaaaaactctcaccaaaataaaaccctataaatgtaaggactgtgggaaagccttcacttgtcattcagatcttactaatcatgtgcgaattcacactggagagaagccctataaatgtaaggaatgtgggaaggccttccgtacatcctcaggacgtattcaacatttaagaactcatatgggagagaaaccctttgaatgtgaccagtgtgggaaagcctttgcttctttctcagctcgtattgcacatttgaaaacacactagagagaagccctgtggatgtgaagaatgtggaaaaacctttgctgtttcctcaagcctaactgaacat

SEQ ID NO: 202946 - DNA, 4693 bp, Homo sapiens
  Payload ID: 20025
  Gene Name: zinc finger protein 561
  Uniprot ID: Q8N587
  ENST ID: ENST00000302851
  CDS Start-End: 365-1825
gttctgcatccccctccctgagccaaccccaggccctttctgcacccacccgagaggaaactagaatttctgtgttctacccggtcctacgtggctgaaactggagcccacgagcctcgcccggccagagtgttgaagcggaagtgacgtcagcgcaccaccgccatcttttccggcgctggctcctctccgtcagtgcggtttcgcctttatggtggtggagtctgcccaggctgtggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcaggattcagtgacgtttgatgatgtggctgtggacttcaccccagaggagtgggctttactggacacaactgagaaatacctctacagagatgtgatgctggagaactacatgaacctggcctctgtggaatgggaaatacaacctagaaccaaacggtcatcacttcagcagggttttttgaagaatcaaatattcagtgggatacaaatgacaagaggctacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcacagcttcttcacacctaaagcagtgtgtagcagttcatacaggaaagaaatccaaaaagactaagaaatgtgggaaatccttcactaatttttctcaactttatgcacctgtgaaaactcataaaggagagaagtcctttgaatgtaaagaatgtggaagatcctttagaaattcctcatgccttaatgatcacattcaaattcacactggaataaaaccacacaagtgtacttactgtgggaaagccttcactagatcaactcaacttactgaacatgtaagaactcacactggaataaaaccctatgaatgtaaggaatgtggccaagcctttgctcagtactcgggcctttctatacacatacgaagtcacagtggaaagaaaccctatcagtgtaaggaatgtgggaaagccttcactacatccacaagtcttattcagcatacaagaattcacacaggagagaagccttatgaatgtgttgaatgtgggaagaccttcattacttcttcccgtcgtagtaaacatttgaaaactcatagtggagaaaagccctttgtatgcaagatatgtgggaaagcatttctatattcctcacgccttaatgttcacctgcgaactcataccggagagaaacccttcgtatgtaaagaatgtgggaaagcatttgctgtttcctcacgcctaagtagacatgaaagaattcacactggggagaaaccctatgaatgcaaggatatgagtgttaccatttagcccatcggttgccatctttaattattggcaatgacaccaaagattatcagatttgtcctaaatgccttttggaggttgtaatgactcatggattggccttagataccatcctgagggtctgaaattaaacctacaggttctgaatacaacatcatggttgcctgagtctgggcatctgtgaagaagggtcatggatggtgaggtcagtactgcaggctgcctcaccttggtgattagattcctaagatcatagcattaacaagttgtgtatgagataaatcatgcagattgaccccagcccctgttggttagtggctgccagtgtggcacatttatgtcaaaatttaccagaagccaagatgatgtaggaccccaaaggtgggttgttaagagatgctcctccaagggtctcttctgatcccacggatcctgcagagcgtgtcaggaatgaaaccatccataactgccagtgccctttcacagctgattatttctgtgtccccttgtaaaatctaagaagtgtgacagccttgcctgttctgccttgtatgtctattttagatggcacaatgtaagtggcaatgtctcttctagtataatccagtctctcttctcacttctgtcaaggtggctgatatagtccatgaatcccactcatgatctctttatcagatgatcgttcagccacactttgaggattctcttcagtacaagttttctaatttttgcattatggataggctgagaattttccaaatctccaagttctggttcctttttccttaacaattttttctgcaattcaggtctccttttgcatttttgctgagaccagctgggtcatggagaccctgacccagcagctctagaggaattaagacaaagacacagaaatagagtgcagagtgggaatcggggctcacagccttcagagctgagagccttgaacagagtttgacccacatatttattgacagtaagcctgtgataaacattatttctatagattatagattagctaaaagtattccttacaagaaagaaagggacaggctctggcttgttatctgcaacaggaacatgtccttaaggcacaaatcactcatggtattgtttgtggtttaggaatgcctgagcagttttccagttttccaccgtgggtgggccaggtgttccttgccctcattcgggtaaaccagcaacctccagcatgggtgtcatagccatcacgagcatgtcacagtgccgcagagattttgtttatgggcagtttctcatggcctgtttatgtccaaatttggggggcctgttctgagcacattttcctgtaagcactcaggaagaatgaagcttcctgtgtcctttaacactttaagtacagatcttagtgatacataaccagttttatctctctcaagctctaccttccgcaaagtgctagaatacagttctgccaagttcttcactacttcgtatcaagggttgtattttctttatttcccaatagcatgttcctcattccccaatgacacctcaccaggatcacccttaccaaccttacttccagcttgcacatcagaatttttccagcctcatttgtcagtttcaaatctgcttcacatttttagtttttttgtttgtttgtttttaatctgccttaatgagctcaggccactatcacaaaataccacagaccaaatggcttacaaatttgttaattttaaataaatgaggttaaaaacaaatttatattctcacatttctcgaggctggaagtctgagatcagagtgccagcatggtcaacttctggcgagagctctcttcctggtatgtaaatgcccacttcctcatgtcttcacaggaaggaaaccaacaaataggtctctctctcctctctcctttctcctctctcctctctcctctttctctctctctccccaccatctctctccttcccctccctccccctccctccccctacccatctcttgacatcatttcacgatacttctaaagagcctattttcaggccgggcgcggtggctcacacctgtaatcccagcactttgggaggccgaggtgggcggatcacgaggtcaggagatcgagactgtcctagttaacacggtgaaaccctgtctctactacaaatacaaaaaattagcctggcgtggtggcgggtacctgcagtcccagctactcgggaggctgaggcaggagaatggcatgaacctgggaggcacaggttgcagtgagccgagatcgcagccactgcattccagcctggacaacagagcgagactctgtctcaaaaacaaaactaaaaaaccctattttcacatacagtcacattgggatttggagcttcaacatatgaattttcagggttatcattcagtccaaagtacttaatatgattcttttccgtttccacatagacaatcacataatctgtaaataatgactcttacttttccactttagtcgttaggttatacctatatatatattttcttgctttactggactaatttcaacctccagcacaccaccaatgaatagcagtaataccagcataattgtctgcagttctgctgagatacgtgctctattttattggcttggctgtaggtttttattttattttttgaagaggctaatctcttacaggaaaggtttctttttatatccagtttttacatgatgaatgatttcccagtatttcataattcatgaggctgaattcctcttgaatttattaaatgcttcctgtgcatcctctgtgatgatcatgtttatttactgctagaactcaagtacctagaactgttcctggccaatgatggtatgtaataaatacttcaatg

SEQ ID NO: 202947 - DNA, 2017 bp, Homo sapiens
  Payload ID: 20025
  Gene Name: zinc finger protein 561
  ENST ID: ENST00000326044
  CDS Start-End: 196-468
tttccggcgctggctcctctccgtcagtgcggtttcgcctttatggtggtggagtctgcccaggctgtggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcaggattcagtgacgtttgatgatgtggctgtggacttcaccccagaggagtgggctttactggacacaactgagaaatacctctacagagatgtgatgctggagaactacatgaacctggcctctgtggacaagaggctacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcacagcttcttcacacctaaagcagtgtgtagcagttcatacaggaaagaaatccaaaaagactaagaaatgtgggaaatccttcactaatttttctcaactttatgcacctgtgaaaactcataaaggagagaagtcctttgaatgtaaagaatgtggaagatcctttagaaattcctcatgccttaatgatcacattcaaattcacactggaataaaaccacacaagtgtacttactgtgggaaagccttcactagatcaactcaacttactgaacatgtaagaactcacactggaataaaaccctatgaatgtaaggaatgtggccaagcctttgctcagtactcgggcctttctatacacatacgaagtcacagtggaaagaaaccctatcagtgtaaggaatgtgggaaagccttcactacatccacaagtcttattcagcatacaagaattcacacaggagagaagccttatgaatgtgttgaatgtgggaagaccttcattacttcttcccgtcgtagtaaacatttgaaaactcatagtggagaaaagccctttgtatgcaagatatgtgggaaagcatttctatattcctcacgccttaatgttcacctgcgaactcataccggagagaaacccttcgtatgtaaagaatgtgggaaagcatttgctgtttcctcacgcctaagtagacatgaaagaattcacactggggagaaaccctatgaatgcaaggatatgagtgttaccatttagcccatcggttgccatctttaattattggcaatgacaccaaagattatcagatttgtcctaaatgccttttggaggttgtaatgactcatggattggccttagataccatcctgagggtctgaaattaaacctacaggttctgaatacaacatcatggttgcctgagtctgggcatctgtgaagaagggtcatggatggtgaggtcagtactgcaggctgcctcaccttggtgattagattcctaagatcatagcattaacaagttgtgtatgagataaatcatgcagattgaccccagcccctgttggttagtggctgccagtgtggcacatttatgtcaaaatttaccagaagccaagatgatgtaggaccccaaaggtgggttgttaagagatgctcctccaagggtctcttctgatcccacggatcctgcagagcgtgtca

SEQ ID NO: 202948 - DNA, 578 bp, Homo sapiens
  Payload ID: 20025
  Gene Name: zinc finger protein 561
  ENST ID: ENST00000444519
  CDS Start-End: 197-382
ttttccggcgctggctcctctccgtcagtgcggtttcgcctttatggtggtggagtctgcccaggctgtggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcagcatttatcaggtatctgcagtgtgctgaggagtgtgctgcatagacaccaatgggacaggaagagctcctagcctggttgtgctgagatcaagcgtaagcagtgtgcagtggctcatgcctgtaattccagctactcaggagacagaggattcagtgacgtttgatgatgtggctgtggacttcaccccagaggagtgggctttactggacacaactgagaaatacctctacagagatgtgatgctggagaactacatgaacctggcc

SEQ ID NO: 202949 - DNA, 1031 bp, Homo sapiens
  Payload ID: 20025
  Gene Name: zinc finger protein 561
  ENST ID: ENST00000444611
  CDS Start-End: 169-1031
atcttttccggcgctggctcctctccgtcagtgcggtttcgcctttatggtggtggagtctgcccaggctgtggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggaaccaatctgcccttttgaagaaaagacaaaggtagaaaggatggtggaggactacctggcaagtggttatcaggattcagtgacgtttgatgatgtggctgtggacttcaccccagaggagtgggctttactggacacaactgagaaatacctctacagagatgtgatgctggagaactacatgaacctggcctctgtggaatgggaaatacaacctagaaccaaacggtcatcacttcagcagggttttttgaagaatcaaatattcagtgggatacaaatgacaagaggctacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcacagcttcttcacacctaaagcagtgtgtagcagttcatacaggaaagaaatccaaaaagactaagaaatgtgggaaatccttcactaatttttctcaactttatgcacctgtgaaaactcataaaggagagaagtcctttga

SEQ ID NO: 202950 - DNA, 4419 bp, Homo sapiens
  Payload ID: 20025
  Gene Name: zinc finger protein 561
  ENST ID: ENST00000424629
  CDS Start-End: 292-1545
gtcagtgcggtttcgcctttatggtggtggagtctgcccaggctgtggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtggattcagtgacgtttgatgatgtggctgtggacttcaccccagaggagtgggctttactggacacaactgagaaatacctctacagagatgtgatgctggagaactacatgaacctggcctctgtggaatgggaaatacaacctagaaccaaacggtcatcacttcagcagggttttttgaagaatcaaatattcagtgggatacaaatgacaagaggctacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcacagcttcttcacacctaaagcagtgtgtagcagttcatacaggaaagaaatccaaaaagactaagaaatgtgggaaatccttcactaatttttctcaactttatgcacctgtgaaaactcataaaggagagaagtcctttgaatgtaaagaatgtggaagatcctttagaaattcctcatgccttaatgatcacattcaaattcacactggaataaaaccacacaagtgtacttactgtgggaaagccttcactagatcaactcaacttactgaacatgtaagaactcacactggaataaaaccctatgaatgtaaggaatgtggccaagcctttgctcagtactcgggcctttctatacacatacgaagtcacagtggaaagaaaccctatcagtgtaaggaatgtgggaaagccttcactacatccacaagtcttattcagcatacaagaattcacacaggagagaagccttatgaatgtgttgaatgtgggaagaccttcattacttcttcccgtcgtagtaaacatttgaaaactcatagtggagaaaagccctttgtatgcaagatatgtgggaaagcatttctatattcctcacgccttaatgttcacctgcgaactcataccggagagaaacccttcgtatgtaaagaatgtgggaaagcatttgctgtttcctcacgcctaagtagacatgaaagaattcacactggggagaaaccctatgaatgcaaggatatgagtgttaccatttagcccatcggttgccatctttaattattggcaatgacaccaaagattatcagatttgtcctaaatgccttttggaggttgtaatgactcatggattggccttagataccatcctgagggtctgaaattaaacctacaggttctgaatacaacatcatggttgcctgagtctgggcatctgtgaagaagggtcatggatggtgaggtcagtactgcaggctgcctcaccttggtgattagattcctaagatcatagcattaacaagttgtgtatgagataaatcatgcagattgaccccagcccctgttggttagtggctgccagtgtggcacatttatgtcaaaatttaccagaagccaagatgatgtaggaccccaaaggtgggttgttaagagatgctcctccaagggtctcttctgatcccacggatcctgcagagcgtgtcaggaatgaaaccatccataactgccagtgccctttcacagctgattatttctgtgtccccttgtaaaatctaagaagtgtgacagccttgcctgttctgccttgtatgtctattttagatggcacaatgtaagtggcaatgtctcttctagtataatccagtctctcttctcacttctgtcaaggtggctgatatagtccatgaatcccactcatgatctctttatcagatgatcgttcagccacactttgaggattctcttcagtacaagttttctaatttttgcattatggataggctgagaattttccaaatctccaagttctggttcctttttccttaacaattttttctgcaattcaggtctccttttgcatttttgctgagaccagctgggtcatggagaccctgacccagcagctctagaggaattaagacaaagacacagaaatagagtgcagagtgggaatcggggctcacagccttcagagctgagagccttgaacagagtttgacccacatatttattgacagtaagcctgtgataaacattatttctatagattatagattagctaaaagtattccttacaagaaagaaagggacaggctctggcttgttatctgcaacaggaacatgtccttaaggcacaaatcactcatggtattgtttgtggtttaggaatgcctgagcagttttccagttttccaccgtgggtgggccaggtgttccttgccctcattcgggtaaaccagcaacctccagcatgggtgtcatagccatcacgagcatgtcacagtgccgcagagattttgtttatgggcagtttctcatggcctgtttatgtccaaatttggggggcctgttctgagcacattttcctgtaagcactcaggaagaatgaagcttcctgtgtcctttaacactttaagtacagatcttagtgatacataaccagttttatctctctcaagctctaccttccgcaaagtgctagaatacagttctgccaagttcttcactacttcgtatcaagggttgtattttctttatttcccaatagcatgttcctcattccccaatgacacctcaccaggatcacccttaccaaccttacttccagcttgcacatcagaatttttccagcctcatttgtcagtttcaaatctgcttcacatttttagtttttttgtttgtttgtttttaatctgccttaatgagctcaggccactatcacaaaataccacagaccaaatggcttacaaatttgttaattttaaataaatgaggttaaaaacaaatttatattctcacatttctcgaggctggaagtctgagatcagagtgccagcatggtcaacttctggcgagagctctcttcctggtatgtaaatgcccacttcctcatgtcttcacaggaaggaaaccaacaaataggtctctctctcctctctcctttctcctctctcctctctcctctttctctctctctccccaccatctctctccttcccctccctccccctccctccccctacccatctcttgacatcatttcacgatacttctaaagagcctattttcaggccgggcgcggtggctcacacctgtaatcccagcactttgggaggccgaggtgggcggatcacgaggtcaggagatcgagactgtcctagttaacacggtgaaaccctgtctctactacaaatacaaaaaattagcctggcgtggtggcgggtacctgcagtcccagctactcgggaggctgaggcaggagaatggcatgaacctgggaggcacaggttgcagtgagccgagatcgcagccactgcattccagcctggacaacagagcgagactctgtctcaaaaacaaaactaaaaaaccctattttcacatacagtcacattgggatttggagcttcaacatatgaattttcagggttatcattcagtccaaagtacttaatatgattcttttccgtttccacatagacaatcacataatctgtaaataatgactcttacttttccactttagtcgttaggttatacctatatatatattttcttgctttactggactaatttcaacctccagcacaccaccaatgaatagcagtaataccagcataattgtctgcagttctgctgagatacgtgctctattttattggcttggctgtaggtttttattttattttttgaagaggctaatctcttacaggaaaggtttctttttatatccagtttttacatgatgaatgatttcccagtatttcataattcatgaggctgaattcctcttgaatttattaaatgcttcctgtgcatcctctgtgatgatcatgtttatttactgctagaactcaagtacctagaactgttcctggccaatgatggtatgtaataaatacttcaatgaaatga

SEQ ID NO: 202951 - DNA, 561 bp, Homo sapiens
  Payload ID: 20025
  Gene Name: zinc finger protein 561
  ENST ID: ENST00000421525
  CDS Start-End: 334-561
atcttttccggcgctggctcctctccgtcagtgcggtttcgcctttatggtggtggagtctgcccaggctgtgggactatcagtcctccctgtgcgtccagttcggagaggctgcgcgctctctcggctcactgcaacctctgcaacctctgcctccagggtcaagcagttctcctgcctcagccttccgagtacctgggattacaggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcaggattcagtgacgtttgatgatgtggctgtggacttcaccccagaggagtgggctttactggacacaactgagaaatacctctacagagatgtgatgctggagaactacatgaac

SEQ ID NO: 202952 - DNA, 912 bp, Homo sapiens
  Payload ID: 20025
  Gene Name: zinc finger protein 561
  ENST ID: ENST00000444802
  CDS Start-End: 198-329
cttttccggcgctggctcctctccgtcagtgcggtttcgcctttatggtggtggagtctgcccaggctgtggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcaggtatctgcagtgtgctgaggagtgtgctgcatagacaccaatgggacaggaagagctcctagcctggttgtgctgagatcaagcgtaagcagtgtgcagtggctcatgcctgtaattccagctactcaggagacagaggattcagtgacgtttgatgatgtggctgtggacttcaccccagaggagtgggctttactggacacaactgagaaatacctctacagagatgtgatgctggagaactacatgaacctggcctctgtggaatgggaaatacaacctagaaccaaacggtcatcacttcagcagggttttttgaagaatcaaatattcagtgggatacaaatgatttcttccattggctcctgaacctggttggatggactgacagaagagtgttcttgaagcccccagagtgactctccccacctgaaagtagggactcagccctatccagagttgcagagggccagagaattgactgctgtctggcgaggctgccgtctatcccccactgcattctctagtccgtcagagcagagggtttcatctgtcctccactgaggctgcagttttacccctgagaacaggtgaatgttcc

SEQ ID NO: 202953 - DNA, 956 bp, Homo sapiens
  Payload ID: 20025
  Gene Name: zinc finger protein 561
  ENST ID: ENST00000443819
  CDS Start-End: 197-313
ttttccggcgctggctcctctccgtcagtgcggtttcgcctttatggtggtggagtctgcccaggctgtggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcagtgaatattggtggaagtgttcattggctcaaaccagcatgtgtatgatgacataggattcagtgacgtttgatgatgtggctgtggacttcaccccagaggagtgggctttactggacacaactgagaaatacctctacagagatgtgatgctggagaactacatgaacctggcctctgtggaatgggaaatacaacctagaaccaaacggtcatcacttcagcagggttttttgaagaatcaaatattcagtgggatacaaatgacaagaggctacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcaca

SEQ ID NO: 202954 - DNA, 659 bp, Homo sapiens
  Payload ID: 20025
  Gene Name: zinc finger protein 561
  ENST ID: ENST00000457965
  CDS Start-End: 236-367
gctggctcctctccgtcagtgcggtttcgcctttatggtggtggagtctgcccaggctgtgggtcaagcagttctcctgcctcagccttccgagtacctgggattacaggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcaggtatctgcagtgtgctgaggagtgtgctgcatagacaccaatgggacaggaagagctcctagcctggttgtgctgagatcaagcgtaagcagtgtgcagtggctcatgcctgtaattccagctactcaggagacagaggattcagtgacgtttgatgatgtggctgtggacttcaccccagaggagtgggctttactggacacaactgagaaatacctctacagagatgtgatgctggagaactacatgaacctggcctctgtggaatgggaaatacaacctagaaccaaacggtcatcacttcagcagg

SEQ ID NO: 202955 - DNA, 566 bp, Homo sapiens
  Payload ID: 20025
  Gene Name: zinc finger protein 561
  ENST ID: ENST00000435550
  CDS Start-End: 443-566
ttttccggcgctggctcctctccgtcagtgcggtttcgcctttatggtggtggagtctgcccaggctgtggtgagttccacctccttggcggtcccggggatagcagggggcggcaaaggaatgattgcgcgctgtcgcctaggagcctctcagatccgcttcacttcactcgcttctccagggactatcagtcctccctgtgcgtccagttcggagaggctgcgcgctctctcggctcactgcaacctctgcaacctctgcctccagggtcaagcagttctcctgcctcagccttccgagtacctgggattacaggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcaggattcagtga

SEQ ID NO: 202956 - DNA, 12380 bp, Homo sapiens
  Payload ID: 20026
  Gene Name: zinc finger protein 562
  Uniprot ID: Q6V9R5
  ENST ID: ENST00000293648
  CDS Start-End: 175-1239
cagtgccgtttaacctttattgtggtggagtccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgtaatggctcacagattggccttagatgcatcccgagggtctgaaattaaacctacaggttctgaatacaacatcatggttacctgagtctgggcatctgtgaagaagggtcatggatggtgaggtcagtactgcaggctgcctcaccttggtgattagattcctaagatcatagcattaacaagttctgtacgagataaatcatgcagattgatcccagcccctgttggttagtggctgccagtgtggcacattcatgtcaaaatttaccagaagccaagatgatgtaggccccagaggtggattgttaaaaagatgctcctccaaggttctcttctgttcccatggatcctgcagagcatgtcaggagtgaaaccatccataactgccagtgccctttcacagctgattatttctatgtccccttcttgtaaaataagaagtgtgacaaccttgactgttctgttctgtcttctctgtccattttaggtggcacaatgtaagtggcagtgtctcttatagtataatccagtctctcttctcacttctgttaagatggctgatatagtccatgaatcccactcatgatctctttatcaaatgattgttcagccacactttgaggattctcttcagtacaagttttctaatttttgcagtatggataggctgagaattttccaaatctccaagttctggttcctttttccttaacaatttcttctgcaattcaggtctccttttgcatttttgccgagaccagctgggtcgtggagaccctaacccagtggctctagaggaattaagacaaagacacagaaatatagtgcagagtgggaatcggggctcacagccttcagagctgagcttgaacagagtttgacccacatatttattgacagtaagcctgtgataaacattattcctatagattgtagatcagctataagtattccttatgagaaagaaagggacaggctctggcttgttatctgcaacaggaatatgtccttaaggcacaaatcactcatgctattgtttgtggtttaggaatgccttgagcagttttccagttttctgccctgggtgggccaggtgttgcttgccctcattctggtaaaccagcagcctccagcatgggcgtcatagccatcacgagcatgtcacagtgctgcagagattttgtttatggccagtttctcattgcctgtttatggccagatttggggggcctgttcccagcacattttcctgtaagcactcaggaataatgaagcttcctgtgtcctttaacactttaattacagatcttagtgatacataccattttatctgtctcaagctctaccttccgtaaaatgctagaatacagttctgccaagttcttcaccactttatatcaagggttgtcttttcttcatttcccaatagcatgttcctcattccccaatgacacctcaccagaataacccttaccaaccttatttccagcttgcacatcagaatttttccagcctctactcatttgtcagtttcaaagctgcttcacatttttagtttttttgtttgtttttaattgcagtacctcacttctcagtaccaatatctgccttagtcagctcagacaaccataagagaataccgcagaccaaatggcttagaaattaatttaattttaaatcaatgaggttaaaaacacaggattttttttttttttttttttttttttttgagatggagttttgctcttgttgcccaggctggagtgcaatggtatgatcttggctcaccgcaacctccacctcctgagttccagtgattctcctgcctcaccctcagtagctgggattattggcatgcaccacaaaccttagctaagtttgtatttttagtagagacagggtttctccatgttggttaggctgatctccatgttggtcagatctgacctttggtgatccacctgccttggcctcccaaagtgctgggattacaggcctgagccaccgtatctggcccaaaacacaaatttatattctcacatatctggaggctggaagtctgagatcagagtgccagcatggtcaacctctagtgagagctctcttcctggcatgtaagtgcccacttcctcatgttttcacacgatggagaccaacaaataggtcggtcggtctcccccctccccgcccccttctcttttcacatacagtcacattgaggtttggaacttcatatgaaatttggggggtcactgtgtgtgtgtgtgtgtgtgtgtgtatgtgtatatatatatacatatatatacacatatgtatgtatacctaactcctaaagtggaacagtaagagtcattatttatagattatctgattctctatgtggaaagagaaaagaatcatattaagtactttggactgaacaatgacccccaaaattcgtatgatgatgaagctctctctaaatattttcttgctttactggactgattttaacccgctgcacaacaccaactaaaagtagtaataccagcatacttgtctttgcagttctggtgagatatgcactctattttgttggtttggctgtaggcttttatttcttttttattttttgaagaggttatgtcctgtcagggaaccagccccgatattcacataggttcttttctattttccctaagtgtcagccaacttgagaaataaagggacagagtacaaaagagagaaattttaaagctgggtgtccggggcagacatcacatgtcggtaggttccgtgatgccccacaagccgcaaaaaccagcaagtttttattagggattttcaaaaggggagggagtgtgcaaataggtgtgggtcacagacatcaagtactttacaaggtaatagaatatcacaaggcaagtggaggcagggcgagatcacaggaccaaggtgaaattaaaattgctaatgaagttttgggcaccattgtcattgataacatcttatcaggagacggttttgagatcaactggtctgactaaaatttattaggtgggaatttcctcttcctaataagcctgggagtgctatgggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggtcagaatttaaggttatctctcttgtttcctaaacattgctgttatcctgttcttttttcaaggtgcccagatttcatattgctcaaacacacatgctgtataatttgtgcagttaatgcaattattacagggtcctgaggtaatatacatcctcctcagctgacaggattgagagattaaagtaaagacaggcataggaaatcacaagggtattgactggggaagtgataagtgtccatgaaatctttacaatttatgtttagagattgcagtaaagacaggcataagaaattataaaagtattaatttggggaactaataaatgtccatgaaaccttcacaatccatgtttttctgccatggcttcagccagtccccccgtttggggtccctgacttcctgcaacaatgtcctgcaggaaaagttttttctttatatccagtttttacatgatgaattatttcccaatatttcatagtttatgaggctgaattcctcttgaatttattaaatgcttccttcacatcctctgtgatgatcatgtttatttactgataaaactcaatacctagaactgcacctagctcatgatggtacctaataaatacttcaatgaaatgatgtggtgatgcatgcctatagttttagctacttgggagggtggcctgagcccaggggttctagaccagcttaggcaacatagcaagaccccatctcaaaaaaaaaaacaaaaacaaaacaaaaaaaaaacttgaagaagtgaatgcatggaaaggcgcttttctaaaacaaatgtggtcaggctgggtgtgggggcttatgcctgtaatcccagcaatttgggaggtgggggtgggcagatcatttgaggtcaagagttcgagaccagcccagccaacatggtgaaaccccatctctactaacaatacaaaaattagctgggtgtggtgatgtgcacctgtaatcccagctacttgggaggctgaagcaggagaatcacttgaacctgggaggtggaggttgcattgagccaagattgcaccactgcactccatgctgggtgacagggtgcgactctgtcaaaaataaataaattaaattaaataaatgtggtatttgtatttattgcttttccaatgttacatcaaccttgtattcctggataagctcgactgtgacataatggatcacttaaaaatacttcatgacctttactaatatgttatggagctatgtttgaataacattgtgatttttaaaaaattgtcccttaatgatatttgtatataatgactgtcatatactgtagtggggcatgttcctactatttctaaattcttaatctataagagtcatctaggttgggaatagtggctcaggcctgtaatcccagcacttttggaggctgaggcaaaaagatcccttgagccaaggagttcaaaccagcctgggcaacatagcgaaaccacatctctatttaaaaatactacaagatattttcatttttttggtttgtttctttgtttttgagttggtgtttgtttctttgtttttgagttagtgtttcactcgttgcccaggctggagtgcaatggtgtgatctcaacttactgcaaattccacctcctgggttccagtggttctcctgcctcagcctcccgagtagctgagattacagacagcctccaccttgcctggctgatttttgtatttttagtagagacggtttcatcaagttggccaggctggtctcaaactcctgacctcaggtgatctgcatgcctcatactcccaaagtactgggattacaggcacaagccactgtgcccggccaatactgcaaaatattttaaaaagttaaaattatctcttctggctggtcatagtggctcacacttttaatcccagcacactgggaagctcagtcagaaggattccttgaggccaggagttcaagatcagtctgggcaacacagaccccatatctccaaaaaaataaaaataaataaataaaacagttatcaggctgggagtggtggctcatgcctgtaatcccaccactttgggaggctgaggcaggcagatcatgaggtcaagagatcaagaccatcctggccaacatgttgaaaccccgtctttactaaaaatacaaaaattagctgggcacggtattgtgcccctgtaatcccagctactcaggaggctgaggcaggagaatctcttgaacccctgaagtggaggtttcaatgagcctagatcacaccactgcactccagcctgacgacagagcgagaatccgtctcaaaaaaaaaaaaaaagacaactaggttgggcacggtgcttcacggctttaatcacagcactttgggaggtcaaggcagggggtcacctgaggtcaggagttcgagaccagcctggccaatgcggtgaaacttttgtctctactaaaaattcaaaaaataaaattagccaggtgagttggcgggcgcctgtaatcccagccgcttgggaggctgaggcaggagaattgcttgaatctgggaggcgaaggttgcagtgagttgagttcttgccactgcactccagcctgggtgacaagagcaaaactccatctcataaaaaaaaaaaaaaaaagacaactaaggcttgcataagtattttgagaatattcttctaggcatgtttttatttccaaatgtgtagcaaaaatttatactttttatatttttcatttttgctggttgtataacttcagtctccttttgcattctggaataacttattaattgtgcattctttccctttgcttgtgttaatcttggtagagagtacccaggtttatgaattctttcagatatttcgcttgaaaaatctacactatttcttgcatgttttctgttccactaattctgttagatatttatatagttacatcagcttgattttcctctacttcttagtctttctgtatgctttttaaaaaaatgtgtctttttatacatactttagctggagttttaaaaaatctgtataccgctgggcatagtggctgatgtctgtaatcacagcactttgggaggccaaggcaggtgatcacctgaggtcgggagttcgagaccagcctgaccaacactgagaaaccccatctctactaaaaatacaaaattagctgtgcctagtggtgcatgcctgtaatgccagctacttgggaggctgaggcaggagaatcatttgaacccgggaggcagaggttgcagtgagccgagatcacgccattgcactgcagcctgggcaacaagagtgaaactctgtcacaaaaaaaaaaaaaaaaagaaaaaatacttgaataataccaattaacaatccttttatgttgcacatttagtgcctgacatttaattagtaataatttggattaatttctagcatctaattttttttgtttgtttcattgtgttcccctctttgtactgatgtgtattgatcatacctttaatttattttattcttgatgtttgaaatttgtatgttacttttcgttgttaccataaataacaattttaaatataagtcttccttaataccttttctttctaactaagtgcactacactgtttgaataaagtgattcccatatacacttactacacttggagagagacccagaaggaagtgcattgtcacacaagctattagacagatctggtggcagaaagaataggctccttgacagaggcccagtgacaccctgtggtagattacagatgtcttgagattactctctgaaggtgcaatctctctcctttttatgtgagccagtccttgctttgaccagtagaaaccagcacaactttggtttgcaagtccatcctcaagaggcttctgctaattaagtagctgctgttttcagctagtaatttttgtggctgtttattacacagtaaaggccaactgatacacatacccctttgcccacaagccaataaactgtggttcttcaggacccactgggaaatcctccagaaccaggcccactcgtgttagcagtaaagaattctgggccaggcacagtggctcatgcctttaaacccagcactttgggaggctgagatggttggatcacgaggccaagagattgagaccattttgggcaacatggtgaacccccatctctactaaaaatacaaaaattagctgggtgtggtggcactcacctgtagtcccagctacttgggggctgagatgggagaatcacttcaacctgggaggtggaggttacagtgagctgatattgcgccacggcactccagcctggtgacagtgtgagactctgtctcaaaaaaaaaaaaaaaattctgtcaatgttcacagagagactgggcatctcccactatgagctgcaatgagaaaatcaagatttgaattcgtattcctctgcttagggactcaggaggccggaagtcagcaggactgaaggcccaaagaaacagttgatgttatgagctgcaagcaagttgccagctgatatggtttggctgtgtccccacccaaatgtcatcttgaattgtagctcccataatccccatggtgtcgagggagagaccaggtgggaggtaatagaatcatgggggggggtttccccatgctgttcaagtaattctcatgcctcagtcagccaagtagctgggataataggcgtgtgctgtttttgtcacagtgagtaaatctcatgaggtctgtcagttttataagcagctgttcccctggacaggctctcttgccttctgccatataagatgtgcctttgctcctccttcaccttctgtcatgattttgaggcctccccagccatgtggaactgtgagtccattaaacctctttttcttcataacttacccagtctcggccaggcacggtggctcacactgtaacaacaacaaggaacacagcacctaaactcacacttttttattttggtagagaaggtatctcactccattgcccaggctgtcctcaaactcctgagctagagtaatcctctcttctgggcctcccaaagtgctgggattacaagcatgagccaccatgcccagccagacatctttacatgacattttcaaggtccaattggtcctaattctccataaatcctttcagagtattaacaatgaagcaaatcttgctaaatctttttatgatgcagtacaagatgtatatatgtatcgtttttatcactgataaaaacagtacagtcattaaaaactacagaattatattggtaatgaatattggtacaaattcactaagtaagccaggtacggtggctcacatgcctgtaatcccagcactttgggaggctgaggcaggtggatcacaaggtcagattgagatgatcctggctaaaacggtgaaaccttgtatctactaaaactaaaaaaatatagctgggcgtggtggcatgtgcatgtattcctagctactcgggaggctgaggcaggaggttacagtgaaccgagatcacaccactgcactccagcctgggatacagagtaagactgtctcaaaaaacaaacaaacaaaaaaatgcgctaagtataatagtagcaactgggcaaagtggcttatgcctggagtctcaacactttgaaaggaggcaaaaggattacttgagctcaggagttcgagacctgcctggacagcatagcaagccccccatctacaaaaaacttaaaaattaaaaaatgcagtgagccaagatcatgccactgcattccagcctgggcaacagagcaagactccatttaaaaaaaaaaaaaaaagaaggaaaaaaggaagctaggaaggaacggattagcaaataaattccaactgcttgataagaaaatagtaaacccagtggcatttactgcaggaatataaggttggctctggctcattcgtatctttgtatttgtgcattcatcattatggatgatgcctggaatttgcccagagggatgctcaagaccctttcagacacattttttttttctaaacttatttatttatgaatgacagagtctcgctctgtcacccaggctggagtgcagtggcgtgatctcagctcactgcaacctccaattcctgggttcaagtgattctcctgcctcagcctcccaagtacctgggattacaggtgtgcaccaccacacccagctaatttttgtattttcagtagaggcggggttttgccatgttggccaggatggtcttgaactcctgagacccccctgattcagcctgattcaacctcccaaagtgctgggattacaggaatgagccacagtggccggtggtgttctttttttttttttttttttccagagacagtgtcttgccatgtcacctaggctggagtgcagtggtgcaatcatagctcactgcagcctcgacctcctgggctcaagcaatcctctcacctcagccttctgagtagctgggaatgcaggcatgtaccaccaggcccggctaatttttttatttttaaatttttttttttttggtcgagactgtgtctcactatattgcccaggctggtcttgaaatcctgttcaagttatccttctgcatcagcctcccaaaatgctaggatgacagggttgagccactgtgcctggcctctatttctaatgtctaggcagcaactgttgttgtgttgttcctgttacatagtcttattacccatttgatacaaagttcagattgattgttcctgttcgtattccattttgggttttccctctatctttgttgattttttaaaaaattaaatatgtaaaagaataaagggccaagcagagtggctcacagttgtaatgccaacaatgtgggaggccaaggaaggatgatcgcttgagctcaggagtttgagggcagcctaggcaacatagagagatctcttctctacaaaatatatttttaaaaattagctggatgtggtggtgcacgtatgtagtccctggtactcaggcaaaggactgcttgagcccaggaagtaaaggctgcagtgagccatgataatgccactatacttcagcctgtgtgacagagtgaaaccctgtttttttttttttttttaaagaaaaaaaagaatgtaattttaaacatcagaactgtaaggtactctgagctggccataccatggtcaagccattgtgacatccccccgcccttgtgataatgtactttgtgatattcccctgcccttgtgaatgtactttataagatacatcctcccccacctagtgaatgtaccctgccattggcccttgtgacagtacacctttcctctccttgtaaatgtactttgtaaccttcctccccacccttgtgatgatacaccctccccgcccttgtgaatgtactttgtaacatcctccccgcccttgagaatgtactttgtaacgtccaccccactgcctacaaaaaaaattgctcctaactccaccgcttatcccaaacctatgagaactaatgataatcccaccaccctttgctgactgttttgttggacagcccatccacatccggatgtaatacacagccattgttgctcgc

SEQ ID NO: 202957 - DNA, 2111 bp, Homo sapiens
  Payload ID: 20026
  Gene Name: zinc finger protein 562
  Uniprot ID: Q6V9R5
  ENST ID: ENST00000453372
  CDS Start-End: 161-1441
ctttattgtggtggagtccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccaggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcagattagtcctaaatgccttttggaggttgtaatggctcacagattggccttagatgcatcccgagggtctgaaattaaacctacaggttctgaatacaacatcatggttacctgagtctgggcatctgtgaagaagggtcatggatggtgaggtcagtactgcaggctgcctcaccttggtgattagattcctaagatcatagcattaacaagttctgtacgagataaatcatgcagattgatcccagcccctgttggttagtggctgccagtgtggcacattcatgtcaaaatttaccagaagccaagatgatgtaggccccagaggtggattgttaaaaagatgctcctccaaggttctcttctgttcccatggatcctgcagagcatgtcaggagtgaaaccatccataactgccagtgccctttcacagct

SEQ ID NO: 202958 - DNA, 1712 bp, Homo sapiens
  Payload ID: 20026
  Gene Name: zinc finger protein 562
  ENST ID: ENST00000590155
  CDS Start-End: 199-1476
ttaccggctgtggctcagcatggtcagtgccgtttaacctttattgtggtggagtccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccaggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatgaaagaattcacactggggagaaatactatgaatgtaaggatatgagtgttgttaccatttagcccattggttgccatctttaattattggcagtgcaaagatcatcag

SEQ ID NO: 202959 - DNA, 491 bp, Homo sapiens
  Payload ID: 20026
  Gene Name: zinc finger protein 562
  ENST ID: ENST00000589542
  CDS Start-End: 144-491
accggctgtggctcagcatggtcagtgccgtttaacctttattgtggtggagtccaccccgctgtgattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccaggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatg

SEQ ID NO: 202960 - DNA, 1475 bp, Homo sapiens
  Payload ID: 20026
  Gene Name: zinc finger protein 562
  ENST ID: ENST00000585688
  CDS Start-End: 197-328
accggctgtggctcagcatggtcagtgccgtttaacctttattgtggtggagtccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccagatttctttttctgcttaacttcagaatgggaaatacaacctagaaccaaacggtcatcacttcagcagggttttttgaagaatcaaatattcactgggatacaaatgacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaactttccaaatttaatccatgtggaaaagtcttcaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtagcagttcatactggaaagaaatccgaaaagactaagaactgtgggaaatccttcactaatttttctcaactttctgcacatgcaaaaactcataaaggagagaagtcctttgaatgtaaagaatgtggaagatcctttagaaattcctcatcctttaatgttcacattcaaattcacactggaataaaaccacacaaatgtacggaatgtgggaaagccttcactagatcaactcaccttactcaacatgtaagaactcacactggaataaaaccctatgaatgtaaggaatgtggccaagccttcactcagtacacgggccttgctatacacatacgaaatcacactggagagaaaccctatcagtgtaaggaatgtgggaaagccttcaatagatcttcaacgcttactcaacatagaagaattcacacaggagagaagccttatgaatgtgttgaatgtgggaagaccttcattacttcttcccatcgtagtaaacatttgaaaactcacagtggagaaaggtaaatgcaagatatgtgggaaagaatttctgtattcctcaccccacctgtgaactcctaccagagagaaaccttttgtatgtaaagaatttgggaaagcatttgctctttcctcatgcctaagtatgcatg

SEQ ID NO: 202961 - DNA, 585 bp, Homo sapiens
  Payload ID: 20026
  Gene Name: zinc finger protein 562
  ENST ID: ENST00000588653
  CDS Start-End: 225-585
atctttaccggctgtggctcagcatggtcagtgccgtttaacctttattgtggtggagtccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatggattcagtgacgtttgatgatgtggctgtggagttcaccccagaggagtgggctttactggacacaactcagaaatacctctacagagatgtgatgctggagaactacatgaacctggcctctgtggatttctttttctgcttaacttcagaatgggaaatacaacctagaaccaaacggtcatcacttcagcagggttttttgaagaatcaaatattcactgggatacaaatgcagacaagaagctacagtggatggaaactctgtgagaattgtggagaggtcttcagtgaacagttttgccttaagacacacatgagagctcagaatggagggaacacttttgagggtaattgtt

SEQ ID NO: 202962 - DNA, 583 bp, Homo sapiens
  Payload ID: 20026
  Gene Name: zinc finger protein 562
  ENST ID: ENST00000587392
  CDS Start-End: 169-444
cgtttaacctttattgtggtggagtccaccccgctgtgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttttttcccagggaaccaatctgtccttttgaagaaaagacaaagataggaacgatggtagaggaccaccggtcaaattcttaccaggattcagtgacgtttgatgatgtggctgtggagttcaccccagaggagtgggctttactggacacaactcagaaatacctctacagagatgtgatgctggagaactacatgaacctggcctctgtggcagacaagaagctacagtggatggaaactctgtgagaattgtggagaggtcttcagtgaacagttttgccttaagacacacatgagagctcagaatggagggaacacttttgagggtaattgttatggaaaagacagcatcagtgtgcacaaggaagcctctattggacaagaa

SEQ ID NO: 202963 - DNA, 577 bp, Homo sapiens
  Payload ID: 20026
  Gene Name: zinc finger protein 562
  ENST ID: ENST00000585350
  CDS Start-End: 548-577
taacctttattgtggtggagtccaccccgctgtggtgagttctacctgcttgggggtccgggacataccagcggggcggcaaaggaaggattgggcgtggtcgcccaggagcctctcagatccgcctagtttcactcgcttttctaggggctgtcagtcctcctggtgcggcctctggccagttccgagaggccgcacagtccgtctggctgcgtcgggaagtgtgtttgttccgcctccgccgggtgttttcttgagtactttcatccgctgtgctcctctcttgaaaagcttggaaagcaacctttgggagtttttttctttccgaaaggaaaaggatttctgcccttctggtgaggttggctctggccccgcattctcccgcgtctggaacctatctcttccggcatgttcctgggcctcagataaccctgtacaaaggggaatggagattgcctgtatccacctagattcataagctgccctgaggcgatcttggcatcaagaaagacagcattgaggcacatctcaccatcagcttcagaggatgtcagcctttgatatgtcccatgggttt

SEQ ID NO: 202964 - DNA, 2754 bp, Homo sapiens
  Payload ID: 20027
  Gene Name: zinc finger protein 563
  Uniprot ID: Q8TA94
  ENST ID: ENST00000293725
  CDS Start-End: 207-1637
gccaggttcaaagagcccgcggcgtcttcacgcccctgcgctcagctctagactcagtcgctcgctgagagacgccctggaacgtctgtgtagcctcagtcgctgagagacgccctggaacgtctgtggcagcctctgtcacagtgggacccgcactggcagcgggaggcagagggaggaccctggaacatcccggaagccgggaaatggacgcagtggcctttgaggatgtggctgtgaacttcacccaggaggaatgggctttgctgggtccatcacagaagaatttatacagatatgtgatgcaagaaaccatcaggaacctggactgtataagaatgatatgggaagaacagaatactgaagatcagtacaaaaatcctaggagaaatctaagatgtcatatggtagagagattcagtgaaagtaaagacagtagtcagtgtggagaaacatttagcctcattcgagatagtattgtgaacaacagcatttgtcctggagaagatccatgtcaaagcgctgagtgtgaagaagtcataatgggtcatttatcccttaatagccacatcagagttgattctggacacaaaccacatgagtatcaggaatatggagagaagccacatacacataaacaacgtgggaaagccttcagttaccatcactcctttcagtcgcgtggaaggcctcacactggaaagaaacgctatgagtgtaaggaatgtggaaaaaccttcagttctcgtagaaaccttcgaagacacatggtagtgcaaggtggaaatagaccttataaatgtaagttgtgtgggaaagcttttttttggcccagtttattacgtatgcatgaaagaactcacactggagagaaaccgtatgaatgtaagcagtgttctaaagcctttcctttttacagttcctatcgaagacatgagagaatgcacactggggagaaaccgtatgaatgtaagcagtgttctaaagccttgcctgattccagttcctatataagacatgaaagaactcacactggagagaaaccatatacatgtaaacagtgtgggaaagccttcagtgtttccagttcccttcgaagacatgaaaccactcacagtgcagagaaaccctatgagtgtaagcaatgcgggaaaacatttcatcatcttggaagctttcagatacacatgaaaaggcacactggagatcgacctcataaatgtaagatatgtgggaaaggctttgatcgtcccagtttagttcgatatcatgaacgaattcacactggagagaaaccctatgaatgcaagcagtgtgggaaaacgttatctcatagctcaagctttcgaagacacatgataatgcacactggaggtggacctcataaatgcaagatatgtgggaaagcttttgtttatcctagtgtatgtcaaagacacgaaaagtctcacagtggagagaaaccctatgaatgcaagcagtgtgggaaagcgttatctcatagctcaagctttcgaagacatatggtaatgcatacgggagatgggccgaataaatgcaaggtatgtgggaaagcctttgtttatcccagtgtatgtcaaagacatgaaaagactcactggagagaaacaatatgaatgtaaactattataaagccttctatatttccagttccctttgatatcatgaataaacttacactggacagaaaccctataaatgtaaatgtgggaaagcctttcataatttttattcctttcaaaatcatgaaatatctcacactggagagatgctgtatgatataaggaatgtgggaaagtgatcgatttttttttaacaccattgtcaacataaaacaactcacagagcagaaaaactctgtgagtgtaaaatatgtagggaagccttcagtcattttggtaacttaaaagtacatgaggctgggcacagtggctcacgcctgtaatcccagcacttagggtgggcaaattgcttgacctcaggaatttgaggcctgcctgggcaaaatggtgaaaccatgtctctacaaaaaatagaaaaagtagcaggtgtggtggtatgcccctgtagtcccagctacttgggaggctgaggtgggaagatctcttgagcccaaggggtgggggttgcagtgagccaagatgcactgcaccccagcctgggcgacagagccagaccctgtctcaaaaaaaaaaaaaaagtacatgaaaggattcactctggagagaagtcatatgaatgtaagaaatgtagaaaagcattgagttctctcaggtccttgcatagacataaaaggactcactggagagatactctataaatgtgtgaaatgtagggaagtattctttaatgttatttcatttcagatagaaataattctcattggagataaaccctatgaatgtaaacacatagtaaagccttaattttaagcctcagtttctttcaaatacagttatcccctaatatttgcaggagcgtggttctaccaccccctgggcatacataaatcgacacatgccaagtccttttttaaaaatgacatatttggtacaaaattacccggatgtgatggcacatgcctgtaatcccagctactcaggaggctgaggcaggataatcacttgaatccgggaggcggaggttgcggtgagccaagatcgcgccactgcactccagcctgggcagcaagagcaaaacaacctctgtcacacacacaaaaaaaaaaaaaaa

SEQ ID NO: 202965 - DNA, 958 bp, Homo sapiens
  Payload ID: 20027
  Gene Name: zinc finger protein 563
  ENST ID: ENST00000595977
  CDS Start-End: 239-928
ctgtcaatcaggcgcacggctggcagtagggtgccaggttcaaagagcccgcggcgtcttcacgcccctgcgctcagctctagactcagtcgctcgctgagagacgccctggaacgtctgtgtagcctcagtcgctgagagacgccctggaacgtctgtggcagcctctgtcacagtgggacccgcactggcagcgggaggcagagggaggaccctggaacatcccggaagccgggaaatggacgcagtggcctttgaggatgtggctgtgaacttcacccaggaggaatgggctttgctgggtccatcacagaagaatttatacagatatgtgatgcaagaaaccatcaggaacctggactgtataagaatgatatgggaagaacagaatactgaagatcagtacaaaaatcctaggagaaatctaagatgtcatatggtagagagattcagtgaaagtaaagacagtagtcagtgtggagaaacatttagcctcattcgagatagtattgtgaacaacagcatttgtcctggagaagatccatgtcaaagcgctgagtgtgaagaagtcataatgggtcatttatcccttaatagccacatcagagttgattctggacacaaaccacatgagtatcaggaatatggagagaagccacatacacataaacaacgtgggaaagccttcagttaccatcactcctttcagtcgcgtggaaggcctcacactggaaagaaacgctatgagtgtaaggaatgtggaaaaaccttcagttctcgtagaaaccttcgaagacacatggtagtgcaaggtggaaatagaccttataaatttcctatcgaagacatgagagaatgcacactggggagaaaccgtatgaatgtaagcagtgttctaaagccttgcctgattccagttcctatataagacatgaaagaactcacactggagagaaac

SEQ ID NO: 202966 - DNA, 749 bp, Homo sapiens
  Payload ID: 20027
  Gene Name: zinc finger protein 563
  ENST ID: ENST00000594577
  CDS Start-End: 168-749
aagccgggaaatgaattagtgaccagagttcctcactgggatctcaggctgctgtcttcaagactggcgcagaggacgcagtggcctttgaggatgtggctgtgaacttcacccaggaggaatgggctttgctgggtccatcacagaagaatttatacagatatgtgatgcaagaaaccatcaggaacctggactgtataagaatgatatgggaagaacagaatactgaagatcagtacaaaaatcctaggagaaatctaagccacatcagagttgattctggacacaaaccacatgagtatcaggaatatggagagaagccacatacacataaacaacgtgggaaagccttcagttaccatcactcctttcagtcgcgtggaaggcctcacactggaaagaaacgctatgagtgtaaggaatgtggaaaaaccttcagttctcgtagaaaccttcgaagacacatggtagtgcaaggtggaaatagaccttataaatgtaagttgtgtgggaaagcttttttttggcccagtttattacgtatgcatgaaagaactcacactggagagaaaccgtatgaatgtaagcagtgttctaaagcctttcctttttacagttcctatcgaagacatgagagaatgcacactggggagaaaccgtatgaatgtaagcagtgttctaaagccttgcctgattccagttcctatataagacatgaaagaactcacactggagagaaaccatataca

SEQ ID NO: 202967 - DNA, 564 bp, Homo sapiens
  Payload ID: 20027
  Gene Name: zinc finger protein 563
  ENST ID: ENST00000601858
  CDS Start-End: 178-564
aacatcccggaagccgggaaatgaattagtgaccagagttcctcactgggatctcaggctgctgtcttcaagactggcgcagaggacgcagtggcctttgaggatgtggctgtgaacttcacccaggaggaatgggctttgctgggtccatcacagaagaatttatacagatatgtgatgcaagaaaccatcaggaacctggactgtataagaatgatatgggaagaacagaatactgaagatcagtacaaaaatcctaggagaaatctaagatgtcatatggtagagagattcagtgaaagtaaagacagtagtcagtgtggagaaacatttagcctcattcgagatagtattgtgaacaacagcatttgtcctggagaagatccatgtcaaagcgctgagtgtgaagaagtcataatgggtcatttatcccttaatagccacatcagagttgattctggacacaaaccacatgagtatcaggaatatggagagaagccacatacacataaacaacgtgggaaagccttcagttaccatcactcctttcagtcgcgtggaagg

SEQ ID NO: 202968 - DNA, 2935 bp, Homo sapiens
  Payload ID: 20028
  Gene Name: zinc finger protein 564
  Uniprot ID: Q8TBZ8
  ENST ID: ENST00000339282
  CDS Start-End: 198-1859
aggaactctgcaagggggacaggggcaatgttcaacaactccgcggggtcttcctgtttcgtgtccgctgcgtttgggttccggtctccgcttctccagtggccccggtggctccaccgcagcgtctggcgcgctgggacctgcacaggccggagagagccgtaggcaggaccccgggacaccctggaagccaggaaatggactcagtggcctctgaggatgtggctgtgaacttcacacttgaggagtgggctttgctggatccttcccagaagaaactctacagagatgtgatgcgggaaacctttagaaacctggcctgtgtaggaaaaaaatgggaagaccagagcattgaagattggtacaaaaatcaggggagaattttaagaaatcatatggaagagggactcagtgaaagtaaagaatatgatcaatgtggagaagccttcagtcagattctcaatcttaatctgaacaagaaaattcctactatagtaagaccatgtgaatgtagtttgtgtgggaaagtcttcatgcatcattcatcccttagtaggcacatcagatctcaccttggacacaaaccatatgactatcaggaatatggagagaaaccatataaatgtaagcagtgtgggaaagccttcagttcttgtcaatcctttcgaagacatgaaagaactcacactggtgagaaaccctatgcatgtccggaatgtgggaaagccttcatttctctcccaagtgttcgaagacacatgattaagcacactggagatggaccatataaatgtcaggaatgtgggaaagcctttgatcgcccaagtttatttcagatacatgaaagaactcacactggagagaaaccctatgaatgtcaggaatgtgcaaaagctttcatttctcttccaagttttcaaagacacatgattaggcacactggagatggaccttataaatgtcaggaatgtggaaaagcctttgaccgccccagtttatttcgaatacatgaaagaactcatactggagagaaaccccatgaatgtaaacagtgtgggaaggccttcatttctttcacaaattttcaaagtcatatgattaggcacactggggatggaccttataaatgtaaagtatgtgggagagcctttatttttcccagttatgttcgaaagcatgaaagaactcatactggggagaaaccctatgaatgtaataaatgtggtaaaaccttcagttcttccagtaatgttcgaacacatgaaaggactcacactggagagaagccctatgaatgtaaggaatgcgggaaagccttcatttctctcccaagtgtccgaagacacatgataaagcacactggagatggaccttataaatgtcaggtatgtggtagagcctttgactgtcccagttcatttcaaatacacgaaagaactcacactggagagaaaccctatgaatgtcaggtatgtgggaaagccttcatttctcttaaaaggattagaaaacatatgatactgcacactggagatggaccttataaatgtcaggtatgtggtaaagcctttgactgtcctagttctgtccgaacacatgaaagaactcatactggagaaaaaccctatgaatgtaaagaatgtgggaaagcattcaattatgccagttccattagaatacatgaaagaactcataccggagaaaaaccctatgaatgtaagcaatgtggaaaaacgttcagttattccagttcctttcaaagacatgaaagagctcataatggagataaaccttacgtaaagaatgtgggaaagctttcatttatcacacaaccttcgaatacctgtgaaaatgaatagtggaggacaggtctacaagtatctacatatctaaagaatatggaaagtcttcagtttgctttctgggtttcagacttgtttgggagctcacccctttctcctgtttctcacttttggaataggaatctctatcctgtgcctgtctcatattttggaaatacatgactagtttggttttcaccggttcggagctgaagaagaattttgcctcagcatgaattgagtctcatccatatctgagtgatgtgatattgagatgacactttggagtttgagtttaaacattaggcttcatgctggaattaactgagacttttgaggcctttgggatgagatgaatatattttacatgtgatgacatggattttgggggccagaggtgtaatgttttggctgagtgtatgccacctcagattcatatgttgaaaccttacccccgtgccccccctctcccccacaatgtgatggtatttggaggccctgtctctggtggtttttaggattggaggacatcatgaagatggaggccttgtaattgggattagtttcctgataggaatccctagagagctagctttgcccttcaccatgagagggtgcagtgagaagatagctatctttgaaccgggaagcaggcccttaccagacatggactatgccagtgccttgatattggacttcccagcctcccaaaccatgagaaataaatgtttgttgattaattaagctttccaatttatggtattttgttttagcaacccaagctaagacacaatccaattttaaaatggaggaaaggacttgaatagacatttctccaaagaagatacccagatggccaataagcacgtaacaatgctcgacatctttagtcattagggaaatacaaatcaaactcaagacatacatagcatctcattaggattagtagtatcaaagatggaaaacaagaaatactgtcaaggatgtggaatgttggagaacattgtgcactatcactgggaatgtacagtggtataagcctgctgaaaacagtatggcagatccccagattaaaatatagaaataacatatga

SEQ ID NO: 202969 - DNA, 255 bp, Homo sapiens
  Payload ID: 20028
  Gene Name: zinc finger protein 564
  ENST ID: ENST00000416136
  CDS Start-End: 103-168
ccagtggccccggtggctccaccgcagcgtctggcgcgctgggacctgcacaggccggagagagccgtaggcaggaccccgggacaccctggaagccaggaaatgggtagagattttgtcgtaatggataactgttctgtatcctttcatctggactttggtgattaatgctaaatcctatcagatgggactttgaaatattaaatattagtgaattaaatattagtaaagaagttgtcatggaagtaacaataa

SEQ ID NO: 202970 - DNA, 575 bp, Homo sapiens
  Payload ID: 20028
  Gene Name: zinc finger protein 564
  ENST ID: ENST00000427105
  CDS Start-End: 136-345
gtccgctgcgtttgggttccggtctccgcttctccagtggccccggtggctccaccgcagcgtctggcgcgctgggacctgcacaggccggagagagccgtaggcaggaccccgggacaccctggaagccaggaaatgacagagtttcgctctgtcgcccaggctggagtgcagtgggaagatctcagctcactgcaaccttcgccttccgggttcaagcaattctcctgcctcagcctcctgagtaactgggattacaggcatgcgccgccacgaccggctactttttgtatttttggtagaaactgggtttctccatgttggccaggactcagtggcctctgaggatgtggctgtgaacttcacacttgaggagtgggctttgctggatccttcccagaagaaactctacagagatgtgatgcgggaaacctttagaaacctggcctgtgtaggaaaaaaatgggaagaccagagcattgaagattggtacaaaaatcaggggagaattttaagaaatcatatggaagagggactcagtgaaagtaaagaatatgatcaatgtggagaagcct

SEQ ID NO: 202971 - DNA, 524 bp, Homo sapiens
  Payload ID: 20028
  Gene Name: zinc finger protein 564
  ENST ID: ENST00000596193
  CDS Start-End: 420-524
aaaccatccaatcaggaactctgcaagggggacaggggcaatgttcaacaactccgcggggtcttcctgtttcgtgtccgctgcgtttgggttccggtctccgcttctccagtggccccggtggctccaccgcagcgtctggcgcgctgggacctgcacaggccggagagagccgtaggcaggaccccgggacaccctggaagccaggaaatgagtctccatccccaggctggagtctagtggcgcgattttggctcactgtaacttccgcctcttgggttcaagcaattctcctgcctcagcctcccaagtagttgggattacaggactcagtggcctctgaggatgtggctgtgaacttcacacttgaggagtgggctttgctggatccttcccagaagaaactctacagagatgtgatgcgggaaacctttagaaacctggcctgtgtaggaaaaaaatgggaagaccagagcattgaagattggtacaaaaatcaggggagaattttaagaaatcatatg

SEQ ID NO: 202972 - DNA, 2023 bp, Homo sapiens
  Payload ID: 20029
  Gene Name: zinc finger protein 565
  Uniprot ID: Q8N9K5
  ENST ID: ENST00000304116
  CDS Start-End: 118-1617
ggcgagctagttagctccgcaaggacccggacgcgaccaggggaggcagaaggactctgcacttgtccaagagaagaatccagagaaatcagagcaggtcaaatagttctaaaagccatggcccagggactggtgacattcagggacgtggccatagagttctctctggaagaatggaagtgcctggaacctgctcagagggacttgtacagggaggtgactctggagaactttggtcacttggcctcactaggactctccatttctaagcctgatgtcgtctccttattggagcaagggaaagagccctggatgattgcaaatgatgtgacaggaccatggtgcccagacttggagtccaggtgtgagaaatttctacaaaaagacatttttgaaatcggggcattcaactgggagataatggaaagccttaaatgcagtgacctggagggctccgattttagagctgactgggaatgcgaaggccagtttgagagacaagtcaatgaagagtgctattttaagcaagtgaacgtcacctatggacatatgcccgtgttccagcatcacacgtctcacactgtacgtcagagcagggagactggtgagaaactgatggaatgtcatgaatgtgggaaagcatttagccgtggctcacaccttattcaacatcagaaaattcacactggtgaaaaaccctttggatgtaaggaatgtgggaaggccttcagccgtgcctcacaccttgttcagcatcagagaattcacacgggtgagaaaccttatgactgtaaggactgtgggaaggcctttggtcgtacatcagaacttattctacatcagagacttcatactggtgtcaaaccttatgaatgtaaagaatgtgggaagacctttaggcagcattcacagctgattctgcatcaaagaactcacacaggcgagaaaccctacgtatgtaaagactgtggcaaggctttcattcgtggctcccaactcactgtgcatcggagaatccacacaggggccagaccctatgagtgtaaagaatgcgggaaagcctttagacagcactcacagctgactgtacaccagcgaatccacactggtgagaaaccctacgagtgtaaggaatgcggaaagggctttattcacagctcagaagttactcgacatcaaagaattcattctggggagaaaccctatgagtgtaaggaatgtgggaaggccttcagacagcacgcacagctcacacgacatcagagagtccatactggcgacagaccctatgaatgtaaggactgcgggaaggcatttagtcgtagctcatacctcattcaacatcaaagaattcatacaggtgacaaaccctacgaatgtaaggaatgtgggaaggcctttattcgtgtttcacaactgactcatcatcagcgaattcacacttgtgagaaaccctatgaatgcagggagtgtggaatggcctttattcgtagttcacaacttaccgaacatcagagaattcatcctggtatcaaaccttacgaatgtagagagtgtgggcaggcatttattcttggctcacaactcattgaacactacagaattcatactggttagaaagccttgagtgtaagggataaagataagcctttatgtggagttcacatctggctcagtactaggtaatttttaatgtagtgtaattaatgtcagaaaacacctgtcacttccatcatagaacatcagaaaactcacacccaaagaaaattaaataaatgtgggaattctttttgcctcactcactgtttcctaagcatcagataatctatgctaaaaaaaaatgaatatagaaaagctgcttcttgccattcaaaatatgttaaatttctgacaattcctaatacaaaaatgacccgattaaaagattctgtggccaggcgtggtggctcatgcctgtaatcccagcactttgggaggccaaggccggcagatcatttgaggtcaggagtttgagaccagcctg

SEQ ID NO: 202973 - DNA, 2519 bp, Homo sapiens
  Payload ID: 20029
  Gene Name: zinc finger protein 565
  Uniprot ID: Q8N9K5
  ENST ID: ENST00000355114
  CDS Start-End: 728-2347
acacacggagacgtgcgcgcacacccacttgtgcagagacacgcgcacgcagacacgtgcgcacagagacgcacacagacacacgtgtgcacacaggcaaacaggcacgcgcagagacgcacacagacacgcgtgtgcaccacaggcaaacagacacgtgcagagacgcacacacaggcacacgtgtgcacacacagagatgcaaacacagacacacgcgtgcacacactgacgcgcgcacagagagacacacgcgcgcacacacacgtctcccccgcgccagctccggctccagcagccttggggtccccgcccagacccgggctcctgactccctcaacgactgcatctcgcggggcgatcccggtcgggttccgcctgagccaaggccccgcacccaaaccgagacagcggatccagtagcccgaggcccgcagctgggcgaaggaaccgggactcaagagtagcctccggcaccgagccctccaagaaaagcagcccgggaccccgacaaccgtggacggagccagggtgggtcatagctcgaggcatcgtcaacggagggtccttaagagaccctgaacccattcacccgggcaccagagactctgccaaagcaccaattcgggcaggtggtagcctcgaagctgggaggctgcatctcaagcctcctcctagatccgcggtggaccctgggaaatgtagtccagagcaagccaccacctaaatgcgccgtggaccctgggaaaggtggtccctcgcaagtcaccgcctggacgcaggactctgcacttgtccaagagaagaatccagagaaatcagagcaggtcaaatagttctaaaagccatggcccagggactggtgacattcagggacgtggccatagagttctctctggaagaatggaagtgcctggaacctgctcagagggacttgtacagggaggtgactctggagaactttggtcacttggcctcactaggactctccatttctaagcctgatgtcgtctccttattggagcaagggaaagagccctggatgattgcaaatgatgtgacaggaccatggtgcccagacttggagtccaggtgtgagaaatttctacaaaaagacatttttgaaatcggggcattcaactgggagataatggaaagccttaaatgcagtgacctggagggctccgattttagagctgactgggaatgcgaaggccagtttgagagacaagtcaatgaagagtgctattttaagcaagtgaacgtcacctatggacatatgcccgtgttccagcatcacacgtctcacactgtacgtcagagcagggagactggtgagaaactgatggaatgtcatgaatgtgggaaagcatttagccgtggctcacaccttattcaacatcagaaaattcacactggtgaaaaaccctttggatgtaaggaatgtgggaaggccttcagccgtgcctcacaccttgttcagcatcagagaattcacacgggtgagaaaccttatgactgtaaggactgtgggaaggcctttggtcgtacatcagaacttattctacatcagagacttcatactggtgtcaaaccttatgaatgtaaagaatgtgggaagacctttaggcagcattcacagctgattctgcatcaaagaactcacacaggcgagaaaccctacgtatgtaaagactgtggcaaggctttcattcgtggctcccaactcactgtgcatcggagaatccacacaggggccagaccctatgagtgtaaagaatgcgggaaagcctttagacagcactcacagctgactgtacaccagcgaatccacactggtgagaaaccctacgagtgtaaggaatgcggaaagggctttattcacagctcagaagttactcgacatcaaagaattcattctggggagaaaccctatgagtgtaaggaatgtgggaaggccttcagacagcacgcacagctcacacgacatcagagagtccatactggcgacagaccctatgaatgtaaggactgcgggaaggcatttagtcgtagctcatacctcattcaacatcaaagaattcatacaggtgacaaaccctacgaatgtaaggaatgtgggaaggcctttattcgtgtttcacaactgactcatcatcagcgaattcacacttgtgagaaaccctatgaatgcagggagtgtggaatggcctttattcgtagttcacaacttaccgaacatcagagaattcatcctggtatcaaaccttacgaatgtagagagtgtgggcaggcatttattcttggctcacaactcattgaacactacagaattcatactggttagaaagccttgagtgtaagggataaagataagcctttatgtggagttcacatctggctcagtactaggtaatttttaatgtagtgtaattaatgtcagaaaacacctgtcacttccatcatagaacatcagaaaactcacacccaaagaaaattaaataaatgtgggaattctt

SEQ ID NO: 202974 - DNA, 1931 bp, Homo sapiens
  Payload ID: 20029
  Gene Name: zinc finger protein 565
  Uniprot ID: Q8N9K5
  ENST ID: ENST00000392173
  CDS Start-End: 260-1759
agtctccgcgacgcggcccgcctcggtcaccgcggccaggcccaggctggtactgaattaccttctattaccagcaacgtcgcttctcaggccttggactacatttcccttgaggctttactggtcgactctctgtctcctcccctccccccgcgaacttggccgcctccttctgtgacgatggagctcttgaggactctgcacttgtccaagagaagaatccagagaaatcagagcaggtcaaatagttctaaaagccatggcccagggactggtgacattcagggacgtggccatagagttctctctggaagaatggaagtgcctggaacctgctcagagggacttgtacagggaggtgactctggagaactttggtcacttggcctcactaggactctccatttctaagcctgatgtcgtctccttattggagcaagggaaagagccctggatgattgcaaatgatgtgacaggaccatggtgcccagacttggagtccaggtgtgagaaatttctacaaaaagacatttttgaaatcggggcattcaactgggagataatggaaagccttaaatgcagtgacctggagggctccgattttagagctgactgggaatgcgaaggccagtttgagagacaagtcaatgaagagtgctattttaagcaagtgaacgtcacctatggacatatgcccgtgttccagcatcacacgtctcacactgtacgtcagagcagggagactggtgagaaactgatggaatgtcatgaatgtgggaaagcatttagccgtggctcacaccttattcaacatcagaaaattcacactggtgaaaaaccctttggatgtaaggaatgtgggaaggccttcagccgtgcctcacaccttgttcagcatcagagaattcacacgggtgagaaaccttatgactgtaaggactgtgggaaggcctttggtcgtacatcagaacttattctacatcagagacttcatactggtgtcaaaccttatgaatgtaaagaatgtgggaagacctttaggcagcattcacagctgattctgcatcaaagaactcacacaggcgagaaaccctacgtatgtaaagactgtggcaaggctttcattcgtggctcccaactcactgtgcatcggagaatccacacaggggccagaccctatgagtgtaaagaatgcgggaaagcctttagacagcactcacagctgactgtacaccagcgaatccacactggtgagaaaccctacgagtgtaaggaatgcggaaagggctttattcacagctcagaagttactcgacatcaaagaattcattctggggagaaaccctatgagtgtaaggaatgtgggaaggccttcagacagcacgcacagctcacacgacatcagagagtccatactggcgacagaccctatgaatgtaaggactgcgggaaggcatttagtcgtagctcatacctcattcaacatcaaagaattcatacaggtgacaaaccctacgaatgtaaggaatgtgggaaggcctttattcgtgtttcacaactgactcatcatcagcgaattcacacttgtgagaaaccctatgaatgcagggagtgtggaatggcctttattcgtagttcacaacttaccgaacatcagagaattcatcctggtatcaaaccttacgaatgtagagagtgtgggcaggcatttattcttggctcacaactcattgaacactacagaattcatactggttagaaagccttgagtgtaagggataaagataagcctttatgtggagttcacatctggctcagtactaggtaatttttaatgtagtgtaattaatgtcagaaaacacctgtcacttccatcatagaacatcagaaaactcacacccaaagaaaattaaataaatgtgggaattctt

SEQ ID NO: 202975 - DNA, 1217 bp, Homo sapiens
  Payload ID: 20029
  Gene Name: zinc finger protein 565
  ENST ID: ENST00000591473
  CDS Start-End: 439-1217
agcgtcagatgacttcaagcttgctggaaggtctggagtggcgacgccctctccgaagactcgtgggcgcaaaaatgtcaaaacgagccaggccccgactcagagataagagaacgccattctgtccgtggccgatctagctctggactacaattcccagagcccacagcggcctgacgttacgtcgttcttgacgtcgtggcgagctagttagctccgcaaggacccggacgcgaccaggggaggcagaagggactggtgacattcagggacgtggccatagagttctctctggaagaatggaagtgcctggaacctgctcagagggacttgtacagggaggtgactctggagaactttggtcacttggcctcactaggactctccatttctaagcctgatgtcgtctccttattggagcaagggaaagagccctggatgattgcaaatgatgtgacaggaccatggtgcccagacttggagtccaggtgtgagaaatttctacaaaaagacatttttgaaatcggggcattcaactgggagataatggaaagccttaaatgcagtgacctggagggctccgattttagagctgactgggaatgcgaaggccagtttgagagacaagtcaatgaagagtgctattttaagcaagtgaacgtcacctatggacatatgcccgtgttccagcatcacacgtctcacactgtacgtcagagcagggagactggtgagaaactgatggaatgtcatgaatgtgggaaagcatttagccgtggctcacaccttattcaacatcagaaaattcacactggtgaaaaaccctttggatgtaaggaatgtgggaaggccttcagccgtgcctcacaccttgttcagcatcagagaattcacacgggtgagaaaccttatgactgtaaggactgtgggaaggcctttggtcgtacatcagaacttattctacatcagagacttcatactggtgtcaaaccttatgaatgtaaagaatgtgggaagacctttaggcagcattcacagctgattctgcatcaaagaactcacacaggcgagaaaccctacgtatgtaaagactgtggcaaggctttcattcgtggctcccaactcactgtgcatcggagaatccacacaggggccagaccctatgagtgtaaagaatgcgggaaagcctttagacagcactcacagctgactgtaca

SEQ ID NO: 202976 - DNA, 583 bp, Homo sapiens
  Payload ID: 20029
  Gene Name: zinc finger protein 565
  ENST ID: ENST00000585994
  CDS Start-End: 415-583
aaacaaaaaattaaaaattatctgagtgtggtggcccacacctgtggtcccagctacccgggaagctgaggtgggaggatctcgagcttgagaggtcaaggctgcagtgagccgtgtttgaaccactgcattccagtctagaacctttgaagttaggacagattctggccctggacaggagtgacctcagccttctgagtgacactggatttaggcagatgcctggtgttctgtgaccacacttccctatatgatgtatgccattcacaggacttcggactcagcaactgccagcctcacagtcaatggggaagtgatgttctgcagaaaagcagtagatggtcggaaggactctgcacttgtccaagagaagaatccagagaaatcagagcaggtcaaatagttctaaaagccatggcccagggactggtgacattcagggacgtggccatagagttctctctggaagaatggaagtgcctggaacctgctcagagggacttgtacagggaggtgactctggagaactttggtcacttggcctcactaggactctccatttctaagcctgatgtcgtctcct

SEQ ID NO: 202977 - DNA, 2755 bp, Homo sapiens
  Payload ID: 20030
  Gene Name: zinc finger protein 566
  Uniprot ID: Q969W8
  ENST ID: ENST00000392170
  CDS Start-End: 148-1407
acgcgctggcgggaccctcagggctttaccagcaactaccccagtgccggggagggttctgctgcttcgaaagctggtaaggcctgagctctacccttctccaaaagaagagccaagagaaggtccttttctacaaatatcagagccatggctcaggagtcagtgatgttcagtgatgtgtccgtagacttctctcaggaggagtgggaatgcctgaatgatgatcagagagatttatacagagatgtgatgttggagaattacagcaacctggtttcaatggcagggcattctatttctaaaccaaatgtgatctcctacttggagcaagggaaggagccctggttggctgacagagagctaacaagaggccagtggccagtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaatcggcagtttaagaaagaactcggctctcaggggggacatttcaatcaattggtattcactcatgaagatctgcccactttgagtcaccatccatccttcacattacagcaaatcattaacagtaaaaagaaattctgtgcatctaaagaatataggaaaacctttagacatggctcacagtttgctacacatgagataattcataccattgagaagccttatgaatgtaaggaatgtggaaagtcctttagacatccctcaagactcactcatcatcagaaaattcatactggcaagaaaccctttgaatgtaaggaatgtggaaaaacctttatttgtggctcagaccttactcgacatcacagaattcacactggtgagaaaccctatgaatgtaaggaatgtgggaaagcctttagtagtggttcaaacttcactcgacatcagagaattcacacaggtgagaagccttatgaatgcaaagaatgcgggaaggcctttagtagtggctcaaactttactcaacatcagagaattcatactggggaaaaaccctatgaatgtaaggaatgtggcaatgcctttagtcagagctcacaacttattaaacatcaaagaatccatacaggtgagaaaccttacgaatgtaaggaatgtgaaaaggcttttcgttctggctcagaccttactagacatcagagaattcatactggggagaaaccctatgaatgtaagatatgtgggaaggcttattctcagagttcacagcttattagtcatcatagaattcatactagtgagaaaccctatgaatatagggaatgtggaaagaactttaattatgacccacaacttattcagcatcaaaatttgtactggtgatgaaacagaatatatgaaatgtgtagggaggcttttaattatggctcaaaacagaatttatcttgttaataattcctctagatagaataatgtagaaacattttatttgtggactacagcttattcagcctgggaaaaataatgttggagaaatactctatgaatagaatatactttggaagcccttaactaaacgcttacttctcttgacatcagataattcagtctagcaatatgatagataattcagtctgtcatactgaaaatgacagcacttttaacacctttctaaccttcttaacgtcagagaatttttgtagaaatgtagtcctgtgattgtcattttttcccctaatttctctaattgttacattcttagtattttaatccatattaaatttatatggctataaatttcatctgtttacatcctgatttgtatactattttaaaaatacctttagtacctgggagaagtgacctctttatttttgaagatggcttattctttttgttctttataacattaaggctttcttattgtaaaaatgttcatgaacgacattttactcaatagagattcttcattatcttcatggtgttttgttgtgttactgtaatatcacttatgaaatcctattggtggatatcgtagtctcctctagatattttgccataatacatgccaaaatacaagtccctgctggacattctccctaagcacatctttgtatcatatcttttaattgcagaagtaatgtgtgaatatattttccttataaaagatgcaaacattacaaaaaggcaaatgtaccctttgaccatatcccaaaggatagtctttatcagttcattatttattgctgatcatttttctgttcatatatacatgcgtgtctcagtaaaaattataaaatgggggataattataatacctacctcataatgctttgtgaggattaaatgaattaagatcgataaagtgcttagaattgtgcctgacatgataaatacatactcactgaatgttagtcatcgttattatattcatcatcatcagtattattatttgtagaaaggctttttaacttctgcagaacttagtcaccattaggcagggtgtttgactgaagaaagaccctttgaaggtaacaagttaagaaaatttcccatcatcatgtacttactattgaacatgaaataatcctaggtgttgggggggaaagtactgtgaataatgtgtgtgaaggactttattccgactaatactctttttgtcgcattatatacccagtaaaaaagaaaagagaacataagcaaaatattggtgcactaatgaggaaaaaaa

SEQ ID NO: 202978 - DNA, 584 bp, Homo sapiens
  Payload ID: 20030
  Gene Name: zinc finger protein 566
  ENST ID: ENST00000427002
  CDS Start-End: 112-584
tttaccagcaactaccccagtgccggggagggttctgctgcttcgaaagctgctctacccttctccaaaagaagagccaagagaaggtccttttctacaaatatcagagccatggctcaggagtcagtgatgttcagtgatgtgtccgtagacttctctcaggaggagtgggaatgcctgaatgatgatcagagagatttatacagagatgtgatgttggagaattacagcaacctggtttcaatggcagggcattctatttctaaaccaaatgtgatctcctacttggagcaagggaaggagccctggttggctgacagagagctaacaagaggccagtggccagtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaatcggcagtttaagaaagaactcggctctcaggggggacatttcaatcaattggtattcactcatgaagatctgcccactttgagtcaccatccatc

SEQ ID NO: 202979 - DNA, 2644 bp, Homo sapiens
  Payload ID: 20030
  Gene Name: zinc finger protein 566
  Uniprot ID: Q969W8
  ENST ID: ENST00000424129
  CDS Start-End: 93-1349
gttctgctgcttcgaaagctggtaaggcctgagctctacccttctccaaaagaagagccaagagaaggtccttttctacaaatatcagagccatggctcaggagtcagtgatgttcagtgatgtgtccgtagacttctctcaggaggagtgggaatgcctgaatgatgatcagagagatttatacagagatgtgatgttggagaattacagcaacctggtttcaatggggcattctatttctaaaccaaatgtgatctcctacttggagcaagggaaggagccctggttggctgacagagagctaacaagaggccagtggccagtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaatcggcagtttaagaaagaactcggctctcaggggggacatttcaatcaattggtattcactcatgaagatctgcccactttgagtcaccatccatccttcacattacagcaaatcattaacagtaaaaagaaattctgtgcatctaaagaatataggaaaacctttagacatggctcacagtttgctacacatgagataattcataccattgagaagccttatgaatgtaaggaatgtggaaagtcctttagacatccctcaagactcactcatcatcagaaaattcatactggcaagaaaccctttgaatgtaaggaatgtggaaaaacctttatttgtggctcagaccttactcgacatcacagaattcacactggtgagaaaccctatgaatgtaaggaatgtgggaaagcctttagtagtggttcaaacttcactcgacatcagagaattcacacaggtgagaagccttatgaatgcaaagaatgcgggaaggcctttagtagtggctcaaactttactcaacatcagagaattcatactggggaaaaaccctatgaatgtaaggaatgtggcaatgcctttagtcagagctcacaacttattaaacatcaaagaatccatacaggtgagaaaccttacgaatgtaaggaatgtgaaaaggcttttcgttctggctcagaccttactagacatcagagaattcatactggggagaaaccctatgaatgtaagatatgtgggaaggcttattctcagagttcacagcttattagtcatcatagaattcatactagtgagaaaccctatgaatatagggaatgtggaaagaactttaattatgacccacaacttattcagcatcaaaatttgtactggtgatgaaacagaatatatgaaatgtgtagggaggcttttaattatggctcaaaacagaatttatcttgttaataattcctctagatagaataatgtagaaacattttatttgtggactacagcttattcagcctgggaaaaataatgttggagaaatactctatgaatagaatatactttggaagcccttaactaaacgcttacttctcttgacatcagataattcagtctagcaatatgatagataattcagtctgtcatactgaaaatgacagcacttttaacacctttctaaccttcttaacgtcagagaatttttgtagaaatgtagtcctgtgattgtcattttttcccctaatttctctaattgttacattcttagtattttaatccatattaaatttatatggctataaatttcatctgtttacatcctgatttgtatactattttaaaaatacctttagtacctgggagaagtgacctctttatttttgaagatggcttattctttttgttctttataacattaaggctttcttattgtaaaaatgttcatgaacgacattttactcaatagagattcttcattatcttcatggtgttttgttgtgttactgtaatatcacttatgaaatcctattggtggatatcgtagtctcctctagatattttgccataatacatgccaaaatacaagtccctgctggacattctccctaagcacatctttgtatcatatcttttaattgcagaagtaatgtgtgaatatattttccttataaaagatgcaaacattacaaaaaggcaaatgtaccctttgaccatatcccaaaggatagtctttatcagttcattatttattgctgatcatttttctgttcatatatacatgcgtgtctcagtaaaaattataaaatgggggataattataatacctacctcataatgctttgtgaggattaaatgaattaagatcgataaagtgcttagaattgtgcctgacatgataaatacatactcactgaatgttagtcatcgttattatattcatcatcatcagtattattatttgtagaaaggctttttaacttctgcagaacttagtcaccattaggcagggtgtttgactgaagaaagaccctttgaaggtaacaagttaagaaaatttcccatcatcatgtacttactattgaacatgaaataatcctaggtgttgggggggaaagtactgtgaataatgtgtgtgaaggactttattccgactaatactctttttgtcgcattatatacccagt

SEQ ID NO: 202980 - DNA, 793 bp, Homo sapiens
  Payload ID: 20030
  Gene Name: zinc finger protein 566
  ENST ID: ENST00000452939
  CDS Start-End: 93-793
gtgccggggagggttctgctgcttcgaaagctgctctacccttctccaaaagaagagccaagagaaggtccttttctacaaatatcagagccatggctcaggagtcagtgatgttcagtgatgtgtccgtagacttctctcaggaggagtgggaatgcctgaatgatgatcagagagatttatacagagatgtgatgttggagaattacagcaacctggtttcaatggggcattctatttctaaaccaaatgtgatctcctacttggagcaagggaaggagccctggttggctgacagagagctaacaagaggccagtggccagtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaatcggcagtttaagaaagaactcggctctcaggggggacatttcaatcaattggtattcactcatgaagatctgcccactttgagtcaccatccatccttcacattacagcaaatcattaacagtaaaaagaaattctgtgcatctaaagaatataggaaaacctttagacatggctcacagtttgctacacatgagataattcataccattgagaagccttatgaatgtaaggaatgtggaaagtcctttagacatccctcaagactcactcatcatcagaaaattcatactggcaagaaaccctttgaatgtaaggaatgtggaaa

SEQ ID NO: 202981 - DNA, 5197 bp, Homo sapiens
  Payload ID: 20030
  Gene Name: zinc finger protein 566
  Uniprot ID: Q969W8
  ENST ID: ENST00000434377
  CDS Start-End: 83-1339
ctcggctttgtgcggcggtggagctctacccttctccaaaagaagagccaagagaaggtccttttctacaaatatcagagccatggctcaggagtcagtgatgttcagtgatgtgtccgtagacttctctcaggaggagtgggaatgcctgaatgatgatcagagagatttatacagagatgtgatgttggagaattacagcaacctggtttcaatggggcattctatttctaaaccaaatgtgatctcctacttggagcaagggaaggagccctggttggctgacagagagctaacaagaggccagtggccagtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaatcggcagtttaagaaagaactcggctctcaggggggacatttcaatcaattggtattcactcatgaagatctgcccactttgagtcaccatccatccttcacattacagcaaatcattaacagtaaaaagaaattctgtgcatctaaagaatataggaaaacctttagacatggctcacagtttgctacacatgagataattcataccattgagaagccttatgaatgtaaggaatgtggaaagtcctttagacatccctcaagactcactcatcatcagaaaattcatactggcaagaaaccctttgaatgtaaggaatgtggaaaaacctttatttgtggctcagaccttactcgacatcacagaattcacactggtgagaaaccctatgaatgtaaggaatgtgggaaagcctttagtagtggttcaaacttcactcgacatcagagaattcacacaggtgagaagccttatgaatgcaaagaatgcgggaaggcctttagtagtggctcaaactttactcaacatcagagaattcatactggggaaaaaccctatgaatgtaaggaatgtggcaatgcctttagtcagagctcacaacttattaaacatcaaagaatccatacaggtgagaaaccttacgaatgtaaggaatgtgaaaaggcttttcgttctggctcagaccttactagacatcagagaattcatactggggagaaaccctatgaatgtaagatatgtgggaaggcttattctcagagttcacagcttattagtcatcatagaattcatactagtgagaaaccctatgaatatagggaatgtggaaagaactttaattatgacccacaacttattcagcatcaaaatttgtactggtgatgaaacagaatatatgaaatgtgtagggaggcttttaattatggctcaaaacagaatttatcttgttaataattcctctagatagaataatgtagaaacattttatttgtggactacagcttattcagcctgggaaaaataatgttggagaaatactctatgaatagaatatactttggaagcccttaactaaacgcttacttctcttgacatcagataattcagtctagcaatatgatagataattcagtctgtcatactgaaaatgacagcacttttaacacctttctaaccttcttaacgtcagagaatttttgtagaaatgtagtcctgtgattgtcattttttcccctaatttctctaattgttacattcttagtattttaatccatattaaatttatatggctataaatttcatctgtttacatcctgatttgtatactattttaaaaatacctttagtacctgggagaagtgacctctttatttttgaagatggcttattctttttgttctttataacattaaggctttcttattgtaaaaatgttcatgaacgacattttactcaatagagattcttcattatcttcatggtgttttgttgtgttactgtaatatcacttatgaaatcctattggtggatatcgtagtctcctctagatattttgccataatacatgccaaaatacaagtccctgctggacattctccctaagcacatctttgtatcatatcttttaattgcagaagtaatgtgtgaatatattttccttataaaagatgcaaacattacaaaaaggcaaatgtaccctttgaccatatcccaaaggatagtctttatcagttcattatttattgctgatcatttttctgttcatatatacatgcgtgtctcagtaaaaattataaaatgggggataattataatacctacctcataatgctttgtgaggattaaatgaattaagatcgataaagtgcttagaattgtgcctgacatgataaatacatactcactgaatgttagtcatcgttattatattcatcatcatcagtattattatttgtagaaaggctttttaacttctgcagaacttagtcaccattaggcagggtgtttgactgaagaaagaccctttgaaggtaacaagttaagaaaatttcccatcatcatgtacttactattgaacatgaaataatcctaggtgttgggggggaaagtactgtgaataatgtgtgtgaaggactttattccgactaatactctttttgtcgcattatatacccagtaaaaaagaaaagagaacataagcaaaatattggtgcactaatgaggaaaaaaagtatgaaaagagaaacagcatcatatttaaaaaatggacagagatagaaacatagttacagatttaaaaggttctgttgaatattatgcttttttctaatatgtttgaaaatttaaacaaaatggtttttaaggaaaatatacatcaatattgactccaagaaaattaggactcttcaaagactctcataaacacagagaacagggaaaaattagcatgtgatcagttaactattactaatgaagcaccaaatccagtttctttctaaggaaaactttatcaaatgttcaaggaactatttcagttatatagaagtacacatcttggctcacgcctgtaatcccagcactttgggaggctgagatggaaggatcatttgaggccaggagcttgagaccagcctggccaacatgttgaaaccccatttttactcaaaaatacaaaacttagccaggcatggtggcacatgcctgtaatcccagctactggggaggctgaggcaggagaatcacttgaatgcaggaggtggaggttgcagtgagccaagatcacgccatggcacttcagcctgagcgacagaatgagactattaaaaaaaaaaaaaaaaagtccacagtgtagctttgtttggggttaagttagtgttttgaaatgggccttccctgtgctcaaaacatgctcagcaagcagctccccacgctggacagatcgcatatgtggaaggatgaagtttatgtctgtagaactgttattttatgccccacttccttttttcttagatcctgtgtagacgggtctctctgaacattgtgttactttactttactggcataaggaagtaaaatatttcataataaatttgagaaaagtagagtgagcaaaaatacctgcaaatgagagaattactaaaaatggactgttgtaatgttttgcgttatcaaaatgaaaactgccaaatgagattttgtttactttcttttcttgtgtgcttatgtcttttataaagttcttcatctaaaattatagagatagtgcatttgcacccaaattaatgaaacaataccattaaagagaaagaaaaggggctgggcacagtggcttacgcctgtaatcccagtgctttgggaggccaaggcagggggcagcctggccaatatagtgaaaccccatctctactaaaaatacaaaaattagctgggcgtggtggcatgtgcctgtagtcccagctgctcggaaggctgaggcaggagaatcgcttgaacccgggaggcggaggttgcagtgagctgagatcctgactgcactccagcctgcatgacagagtctcaaaaaatctgtctcaaaaaaaaaaaaaaaaaagaaagaaaaaatgattatctttgcccttctccgttcctcattccctcccctctgtcaattttcttctgaataatatttaaaggttgtgtatattacccatatatttcttcatgctaaaacattaacacacaattattttattatgtttttacagaaaaatggataactatacatttccctgaaatttgcttttttacattcaactgtacattttggattttccttcaatagatgatgatctaacagtctttctgatggttacagtatgttccacagtgttatttaccaatgccttttcaaccactttcccaattgtgatattatggattgtttgcgcttttttgccatctaaaagtaatgctgcaacaaacactttgtattcttgtctgttttatttctataaaataagcttcccaagtcatttccagtgtttttgctttgttttgttttgagacagagtttcactcttgtttcccaggctggagtgcaatggcgcaatcttggcttactgcaatctccgcctcccgggttcaagagattctcctgcctcagcctcccaagtagctggggttacaggtatatgccactacgcctggaaaattttgtatttttagtagagacggcatttttccatgttggtcaggctggtctcgaactcctgacctcaggtgatccaccctcctcggcctcccaaagtgctggcattataggcatgagccaccgcacccggcgtcatttccagtgttttctatgtttcctaggaaggttttgcttctggaagatttcagagggcaagagaataaaggagtggagtgcagtttttcatatatgtgattctgtgagtgtgtatacacagagatttaatattttaatacatcaggaattgattatacgatctaatgcaggatgtcagacttgtttctatccaggaataaaaccagttatgccagaagtaactattattcacctttctcctactgaattaaaatactatcagttgtatattaaatgctcacatctatttctgttctccatattctagcaatccttgacacttttcaatagcttttattacttggaaataaagatgtatgtatatattattaatatatagtttattatttggaaataaagatgtttcttcatgagaa

SEQ ID NO: 202982 - DNA, 3425 bp, Homo sapiens
  Payload ID: 20030
  Gene Name: zinc finger protein 566
  ENST ID: ENST00000493391
  CDS Start-End: 525-1469
gaggctgtccagcgcctgggggcagtaggacgggtccgggaactaagcccatctcaaacacgtcggagtggctttctttgggggccaaggcccgagcctgaggcgggactccatgaggcctctggggcgcgagcggtttgactagggggggcgatcctttcggcggggctgacgcaaggcgcggacaggaattctgacgatcgggaaccatcttgtccggccttgatacgtctctgactacgcttcccagaggtctcctcggcaagactgtacttctcgcggtaattcagcttccaactcacgcgctggcgggaccctcagggctttaccagcaactaccccagtgccggggagggttctgctgcttcgaaagctgctctacccttctccaaaagaagagccaagagaaggtccttttctacaaatatcagagccatggctcagtcctggaatcaagatgtgagaccaagaaattatttctgaagaaagaaatttatgaaatagaatcaacccagtgggaaataatggaaaaactcacaagacgtgattttcagtgctccagtttcagagatgattgggaatgtaatcggcagtttaagaaagaactcggctctcaggggggacatttcaatcaattggtattcactcatgaagatctgcccactttgagtcaccatccatccttcacattacagcaaatcattaacagtaaaaagaaattctgtgcatctaaagaatataggaaaacctttagacatggctcacagtttgctacacatgagataattcataccattgagaagccttatgaatgtaaggaatgtggaaagtcctttagacatccctcaagactcactcatcatcagaaaattcatactggcaagaaaccctttgaatgtaaggaatgtggaaaaacctttatttgtggctcagaccttactcgacatcacagaattcacactggtgagaaaccctatgaatgtaaggaatgtgggaaagcctttagtagtggttcaaacttcactcgacatcagagaattcacacaggtgagaagccttatgaatgcaaagaatgcgggaaggcctttagtagtggctcaaactttactcaacatcagagaattcatactggggaaaaaccctatgaatgtaaggaatgtggcaatgcctttagtcagagctcacaacttattaaacatcaaagaatccatacaggtgagaaaccttacgaatgtaaggaatgtgaaaaggcttttcgttctggctcagaccttactagacatcagagaattcatactggggagaaaccctatgaatgtaagatatgtgggaaggcttattctcagagttcacagcttattagtcatcatagaattcatactagtgagaaaccctatgaatatagggaatgtggaaagaactttaattatgacccacaacttattcagcatcaaaatttgtactggtgatgaaacagaatatatgaaatgtgtagggaggcttttaattatggctcaaaacagaatttatcttgttaataattcctctagatagaataatgtagaaacattttatttgtggactacagcttattcagcctgggaaaaataatgttggagaaatactctatgaatagaatatactttggaagcccttaactaaacgcttacttctcttgacatcagataattcagtctagcaatatgatagataattcagtctgtcatactgaaaatgacagcacttttaacacctttctaaccttcttaacgtcagagaatttttgtagaaatgtagtcctgtgattgtcattttttcccctaatttctctaattgttacattcttagtattttaatccatattaaatttatatggctataaatttcatctgtttacatcctgatttgtatactattttaaaaatacctttagtacctgggagaagtgacctctttatttttgaagatggcttattctttttgttctttataacattaaggctttcttattgtaaaaatgttcatgaacgacattttactcaatagagattcttcattatcttcatggtgttttgttgtgttactgtaatatcacttatgaaatcctattggtggatatcgtagtctcctctagatattttgccataatacatgccaaaatacaagtccctgctggacattctccctaagcacatctttgtatcatatcttttaattgcagaagtaatgtgtgaatatattttccttataaaagatgcaaacattacaaaaaggcaaatgtaccctttgaccatatcccaaaggatagtctttatcagttcattatttattgctgatcatttttctgttcatatatacatgcgtgtctcagtaaaaattataaaatgggggataattataatacctacctcataatgctttgtgaggattaaatgaattaagatcgataaagtgcttagaattgtgcctgacatgataaatacatactcactgaatgttagtcatcgttattatattcatcatcatcagtattattatttgtagaaaggctttttaacttctgcagaacttagtcaccattaggcagggtgtttgactgaagaaagaccctttgaaggtaacaagttaagaaaatttcccatcatcatgtacttactattgaacatgaaataatcctaggtgttgggggggaaagtactgtgaataatgtgtgtgaaggactttattccgactaatactctttttgtcgcattatatacccagtaaaaaagaaaagagaacataagcaaaatattggtgcactaatgaggaaaaaaagtatgaaaagagaaacagcatcatatttaaaaaatggacagagatagaaacatagttacagatttaaaaggttctgttgaatattatgcttttttctaatatgtttgaaaatttaaacaaaatggtttttaaggaaaatatacatcaatattgactccaagaaaattaggactcttcaaagactctcataaacacagagaacagggaaaaattagcatgtgatcagttaactattactaatgaagcaccaaatccagtttctttctaaggaaaactttatcaaatgttcaaggaactatttcagttatatagaagtacacatcttggctcacgcctgtaatcccagcactttgggaggctgagatggaaggatcatttgaggccaggagcttgagaccagcctggccaacatgttgaaaccccatttttactcaaaaatacaaaacttagccaggcatggtggcacatgcctgtaatcccagctactggggaggctgaggcaggagaatcacttgaatgcaggaggtggaggttgcagtgagccaagatcacgccatggcacttcagcctgagcgacagaatgagactattaaaaaaaaaaaaaaaaa

SEQ ID NO: 202983 - DNA, 1154 bp, Homo sapiens
  Payload ID: 20030
  Gene Name: zinc finger protein 566
  ENST ID: ENST00000587567
  CDS Start-End: 1-234
tttgaatgtaaggaatgtggaaaaacctttatttgtggctcagaccttactcgacatcacagaattcacactggtgagaaaccctatgaatgtaaggaatgtgggaaagcctttagtagtggttcaaacttcactcgacatcagagaattcacacagaaaaatggataactatacatttccctgaaatttgcttttttacattcaactgtacattttggattttccttcaatagatgatgatctaacagtctttctgatggttacagtatgttccacagtgttatttaccaatgccttttcaaccactttcccaattgtgatattatggattgtttgcgcttttttgccatctaaaagtaatgctgcaacaaacactttgtattcttgtctgttttatttctataaaataagcttcccaagtcatttccagtgtttttgctttgttttgttttgagacagagtttcactcttgtttcccaggctggagtgcaatggcgcaatcttggcttactgcaatctccgcctcccgggttcaagagattctcctgcctcagcctcccaagtagctggggttacaggtatatgccactacgcctggaaaattttgtatttttagtagagacggcatttttccatgttggtcaggctggtctcgaactcctgacctcaggtgatccaccctcctcggcctcccaaagtgctggcattataggcatgagccaccgcacccggcgtcatttccagtgttttctatgtttcctaggaaggttttgcttctggaagatttcagagggcaagagaataaaggagtggagtgcagtttttcatatatgtgattctgtgagtgtgtatacacagagatttaatattttaatacatcaggaattgattatacgatctaatgcaggatgtcagacttgtttctatccaggaataaaaccagttatgccagaagtaactattattcacctttctcctactgaattaaaatactatcagttgtatattaaatgctcacatctatttctgttctccatattctagcaatccttgacacttttcaatagcttttattacttggaaataaagatgtatgtatatattattaatatatagtttattatttggaaataaagatgtttcttcatgagaa

SEQ ID NO: 202984 - DNA, 2691 bp, Homo sapiens
  Payload ID: 20031
  Gene Name: zinc finger protein 567
  Uniprot ID: Q8N184
  ENST ID: ENST00000360729
  CDS Start-End: 183-2033
gtctttagctctcatggattgggagctgggaaaggaatgagaagacagaagtcagagacaagaagaggctaacatgactgataccactataatttagtggatcagtgtctttcaatgatgtgactgtggacttcactcaggaggagtggcagcacctggatcatgctcagaagactctatatatggatgtgatgttggaaaactattgccacctcatctctgtggggtgtcacatgaccaaacctgatgtgatcctcaagttggaacgaggagaagagccatggacatcatttgcaggtcatacctgcttggaagaaaactggaaagctgaagactttttagtgaaattcaaggaacaccaagagaagtattctagatcagttgtaagcatcaaccacaaaaaactggtgaaggagaagagtaaaatatatgaaaagacatttactctaggcaaaaaccctgtgaattcaaaaaatctacctcctgaatatgatactcatggaaggattttgaaaaatgtttcagaattaatcatcagtaatctaaatcctgcaagaaagagacttagtgagtataatggatatgggaaatcactcctgagtactaaacaagagactactcatcctgaagtcaaatcccataatcaaagtgccagagctttcagtcataatgaagttcttatgcagtatcagaaaacggaaactccagcacagtcatttggatataatgactgtgagaaatcattccttcaaaggggaggcctgattacacatagtagaccttacaaaggagaaaacccatctgtatataataaaaaaagaagagcaaccaatattgaaaaaaaacatacatgcaatgaatgtgggaaatctttctgcaggaaatcagtattgattctgcatcagggaattcactcagaagaaaaaccctatcaatgtcatcaatgtggaaatgcatttagaaggaaatcatatctcattgatcatcagagaactcacacaggagagaaaccctttgtttgcaatgaatgtggtaagtccttccgcctcaagacagccctcactgatcatcagagaacacacacaggggagaaatcgtatgaatgtctgcaatgtaggaatgccttcagattgaagtcacacctcattcgtcatcagagaactcacacgggagagaaaccatatgagtgtaatgactgtgggaagtccttccgccagaagacaacactctctctacatcagagaatccatacaggtgagaaaccctacatttgtaaagaatgtgggaagtcctttcaccagaaggcaaatcttactgtacatcagagaactcatacaggggaaaagccctatatttgtaatgaatgtgggaaatccttctcccagaagacaacccttgctcttcatgagaaaactcataatgaggagaaaccctatatttgtagtgaatgtggaaagtccttccgccagaagacaacccttgtagcacatcagagaacacatacaggggagaaatcttatgaatgtcctcactgtgggaaggcctttagaatgaagtcatacctcattgatcatcaccgaactcacacaggagagaaaccatatgaatgtaatgaatgtggtaaatcattcagtcaaaagacaaatctcaatctacatcagagaattcatacaggggagaaaccctatgtttgtaatgaatgtgggaagtcctttcgccagaaagcaaccctcactgtacatcagaaaatacataccggccagaaatcctatgaatgtcctcagtgtgggaaagcctttagcaggaagtcatatctcattcatcatcaaagaactcatacgggagagaaaccatataaatgtagtgaatgtggaaagtgcttccgccagaagacaaatcttattgtacatcagagaactcacacaggtgagaaaccctatgtttgtaatgagtgtggtaagtctttcagttataagagaaacctcattgtccatcaaagaactcacaagggagaaaacattgaaatgcaataaatgatgtggtttcttatatgaattctttacaagctgttgtaaacatttagttttaaaaagaaaagcatgctgaaacatgttaatgtaattttaaatcacaagtctaataattattaaagtaccatacggaataactgtctactgtttactagcatataaaataagtatgatcattattattgaactctatcagctatgaagctaaattttaaagtcaactgctcttcctactgactcaaatagtttattttttaaaaatacttatataatacatgcagagacaagatacacaatgattataagtattaatctccataagagaaaatatttatgaactatatttctcattgcactctgtaataaaaagcagttagttgttacttacctaagagttaccacttccgtagcctataacatcaaaacgtagtttttgcatgttttcaattttataaatatatattttatcagacatcatgaattattttgtgtcttgcttatttcactcaattttttaagatctgtacattattgcatgtggcagtagtgtattttcattttgcatactattccattttaagaatatattgctgtttatcctattgatggatatttgtattttttatacttttgtgtaataataaaaatactgctgtaaata

SEQ ID NO: 202985 - DNA, 2825 bp, Homo sapiens
  Payload ID: 20031
  Gene Name: zinc finger protein 567
  Uniprot ID: Q8N184
  ENST ID: ENST00000536254
  CDS Start-End: 223-2166
accgaaggtgaggctggtgggtcccgcgggcgcggagaaggcgggtgacggtgtgaccctctttagctctcatggattgggagctgggaaaggaatgagaagacagaagtcagagacaagaagaggctaacatgactgataccactataatttagtgaactgcctcttttctaaagaggactccaaaggaaggactggtcatctctttcatatctcaaaaccatggctcagggatcagtgtctttcaatgatgtgactgtggacttcactcaggaggagtggcagcacctggatcatgctcagaagactctatatatggatgtgatgttggaaaactattgccacctcatctctgtggggtgtcacatgaccaaacctgatgtgatcctcaagttggaacgaggagaagagccatggacatcatttgcaggtcatacctgcttggaagaaaactggaaagctgaagactttttagtgaaattcaaggaacaccaagagaagtattctagatcagttgtaagcatcaaccacaaaaaactggtgaaggagaagagtaaaatatatgaaaagacatttactctaggcaaaaaccctgtgaattcaaaaaatctacctcctgaatatgatactcatggaaggattttgaaaaatgtttcagaattaatcatcagtaatctaaatcctgcaagaaagagacttagtgagtataatggatatgggaaatcactcctgagtactaaacaagagactactcatcctgaagtcaaatcccataatcaaagtgccagagctttcagtcataatgaagttcttatgcagtatcagaaaacggaaactccagcacagtcatttggatataatgactgtgagaaatcattccttcaaaggggaggcctgattacacatagtagaccttacaaaggagaaaacccatctgtatataataaaaaaagaagagcaaccaatattgaaaaaaaacatacatgcaatgaatgtgggaaatctttctgcaggaaatcagtattgattctgcatcagggaattcactcagaagaaaaaccctatcaatgtcatcaatgtggaaatgcatttagaaggaaatcatatctcattgatcatcagagaactcacacaggagagaaaccctttgtttgcaatgaatgtggtaagtccttccgcctcaagacagccctcactgatcatcagagaacacacacaggggagaaatcgtatgaatgtctgcaatgtaggaatgccttcagattgaagtcacacctcattcgtcatcagagaactcacacgggagagaaaccatatgagtgtaatgactgtgggaagtccttccgccagaagacaacactctctctacatcagagaatccatacaggtgagaaaccctacatttgtaaagaatgtgggaagtcctttcaccagaaggcaaatcttactgtacatcagagaactcatacaggggaaaagccctatatttgtaatgaatgtgggaaatccttctcccagaagacaacccttgctcttcatgagaaaactcataatgaggagaaaccctatatttgtagtgaatgtggaaagtccttccgccagaagacaacccttgtagcacatcagagaacacatacaggggagaaatcttatgaatgtcctcactgtgggaaggcctttagaatgaagtcatacctcattgatcatcaccgaactcacacaggagagaaaccatatgaatgtaatgaatgtggtaaatcattcagtcaaaagacaaatctcaatctacatcagagaattcatacaggggagaaaccctatgtttgtaatgaatgtgggaagtcctttcgccagaaagcaaccctcactgtacatcagaaaatacataccggccagaaatcctatgaatgtcctcagtgtgggaaagcctttagcaggaagtcatatctcattcatcatcaaagaactcatacgggagagaaaccatataaatgtagtgaatgtggaaagtgcttccgccagaagacaaatcttattgtacatcagagaactcacacaggtgagaaaccctatgtttgtaatgagtgtggtaagtctttcagttataagagaaacctcattgtccatcaaagaactcacaagggagaaaacattgaaatgcaataaatgatgtggtttcttatatgaattctttacaagctgttgtaaacatttagttttaaaaagaaaagcatgctgaaacatgttaatgtaattttaaatcacaagtctaataattattaaagtaccatacggaataactgtctactgtttactagcatataaaataagtatgatcattattattgaactctatcagctatgaagctaaattttaaagtcaactgctcttcctactgactcaaatagtttattttttaaaaatacttatataatacatgcagagacaagatacacaatgattataagtattaatctccataagagaaaatatttatgaactatatttctcattgcactctgtaataaaaagcagttagttgttacttacctaagagttaccacttccgtagcctataacatcaaaacgtagtttttgcatgttttcaattttataaatatatattttatcagacatcatgaattattttgtgtcttgcttatttcactcaattttttaagatctgtacattattgcatgtggcagtagtgtattttcattttgcatactattccattttaagaatatattgctgtttatcctattgatggatatttgtattttttatacttttgtgtaataataaaaatactgctgtaaatat

SEQ ID NO: 202986 - DNA, 319 bp, Homo sapiens
  Payload ID: 20031
  Gene Name: zinc finger protein 567
  ENST ID: ENST00000589264
  CDS Start-End: 1-195
cacctggatcatgctcagaagactctatatatggatgtgatgttggaaaactattgccacctcatctctgtggggtgtcacatgaccaaacctgatgtgatcctcaagttggaacgaggagaagagccatggacatcatttgcaggtcatacctgcttgggtggagaggatggcctaactggatgtttatcctagcgtcaacccaccaaagatttggggaacatgtgagtcacattctctgggacattctactcccctttgattttgcatttccagacatttcagtggctaccacaaaaaataaaaagtatctgtggca

SEQ ID NO: 202987 - DNA, 3734 bp, Homo sapiens
  Payload ID: 20031
  Gene Name: zinc finger protein 567
  Uniprot ID: Q8N184
  ENST ID: ENST00000585696
  CDS Start-End: 1231-3081
tttgtatttttagtagagacagggtcttgccatgttagctgggctggttttgaactcctgacctcagatgagccaccacgcccagcctcaagctctcgtttctgtcctcccgtcacctttgaggaagtaagtggtggttttatgccatgagagctgtggggtttcaggtaccatgatgcaaaaacagccacaaaattagcagttcttgtacattgcagttgctatccttcaaggataagctcttttccagtttccgcctgctttggttgctttccagtgctattagttgtttattgtatggcatgtgcacattttataattattatctgagggaaagtgtccctgactgttttactctgttaatgctgcatgctgaaaaatctcaccatgcacatacaatattcctccttagtgaagcctgagaaattgttctacctttgtgatacatgctgtatcttgtacatacttctttgttgtacctgtgacaccttcttgcaggtttgtgtttacttacattttcttgcaagtatgtgttacatgcctctggtaacttctgagcagaaacagtgtttgtcttggcacttccataaataaatacagtttttggcattaagtggcttcacagtaaatattcttagaatgtgttatttaaaaactaactgatggatatttttaccttgatttttgttttccctacaatataaatcataaaacagggaaaattgtagtctttctatattaggattcgtatgactgccacaaggaagcagggtcaaaagtagttcccaatatccagtccacctgttctttttcttttccttttttttgacagagtcctgctctgtcgcccaggctggagtgcagtggcatgatctgggctcactgcatcctccgcctcctggtttcaagctattctcctgcctcagcctcccatgtaactgggattacaggcgcacaccactatgcccagctaattttttgtatttttagtagacatggggtttcaccatcttggccagggtggtttttaactcatgacctcaagtgatccacctacctcagcctcccaaagtgctgggattacaggcatgaaccactgtacctggctaagtccacctgttctgattacagttccatccattctagggatcagtgtctttcaatgatgtgactgtggacttcactcaggaggagtggcagcacctggatcatgctcagaagactctatatatggatgtgatgttggaaaactattgccacctcatctctgtggggtgtcacatgaccaaacctgatgtgatcctcaagttggaacgaggagaagagccatggacatcatttgcaggtcatacctgcttggaagaaaactggaaagctgaagactttttagtgaaattcaaggaacaccaagagaagtattctagatcagttgtaagcatcaaccacaaaaaactggtgaaggagaagagtaaaatatatgaaaagacatttactctaggcaaaaaccctgtgaattcaaaaaatctacctcctgaatatgatactcatggaaggattttgaaaaatgtttcagaattaatcatcagtaatctaaatcctgcaagaaagagacttagtgagtataatggatatgggaaatcactcctgagtactaaacaagagactactcatcctgaagtcaaatcccataatcaaagtgccagagctttcagtcataatgaagttcttatgcagtatcagaaaacggaaactccagcacagtcatttggatataatgactgtgagaaatcattccttcaaaggggaggcctgattacacatagtagaccttacaaaggagaaaacccatctgtatataataaaaaaagaagagcaaccaatattgaaaaaaaacatacatgcaatgaatgtgggaaatctttctgcaggaaatcagtattgattctgcatcagggaattcactcagaagaaaaaccctatcaatgtcatcaatgtggaaatgcatttagaaggaaatcatatctcattgatcatcagagaactcacacaggagagaaaccctttgtttgcaatgaatgtggtaagtccttccgcctcaagacagccctcactgatcatcagagaacacacacaggggagaaatcgtatgaatgtctgcaatgtaggaatgccttcagattgaagtcacacctcattcgtcatcagagaactcacacgggagagaaaccatatgagtgtaatgactgtgggaagtccttccgccagaagacaacactctctctacatcagagaatccatacaggtgagaaaccctacatttgtaaagaatgtgggaagtcctttcaccagaaggcaaatcttactgtacatcagagaactcatacaggggaaaagccctatatttgtaatgaatgtgggaaatccttctcccagaagacaacccttgctcttcatgagaaaactcataatgaggagaaaccctatatttgtagtgaatgtggaaagtccttccgccagaagacaacccttgtagcacatcagagaacacatacaggggagaaatcttatgaatgtcctcactgtgggaaggcctttagaatgaagtcatacctcattgatcatcaccgaactcacacaggagagaaaccatatgaatgtaatgaatgtggtaaatcattcagtcaaaagacaaatctcaatctacatcagagaattcatacaggggagaaaccctatgtttgtaatgaatgtgggaagtcctttcgccagaaagcaaccctcactgtacatcagaaaatacataccggccagaaatcctatgaatgtcctcagtgtgggaaagcctttagcaggaagtcatatctcattcatcatcaaagaactcatacgggagagaaaccatataaatgtagtgaatgtggaaagtgcttccgccagaagacaaatcttattgtacatcagagaactcacacaggtgagaaaccctatgtttgtaatgagtgtggtaagtctttcagttataagagaaacctcattgtccatcaaagaactcacaagggagaaaacattgaaatgcaataaatgatgtggtttcttatatgaattctttacaagctgttgtaaacatttagttttaaaaagaaaagcatgctgaaacatgttaatgtaattttaaatcacaagtctaataattattaaagtaccatacggaataactgtctactgtttactagcatataaaataagtatgatcattattattgaactctatcagctatgaagctaaattttaaagtcaactgctcttcctactgactcaaatagtttattttttaaaaatacttatataatacatgcagagacaagatacacaatgattataagtattaatctccataagagaaaatatttatgaactatatttctcattgcactctgtaataaaaagcagttagttgttacttacctaagagttaccacttccgtagcctataacatcaaaacgtagtttttgcatgttttcaattttataaatatatattttatcagacatcatgaattattttgtgtcttgcttatttcactcaattttttaagatctgtacattattgcatgtggcagtagtgtattttcattttgcatactattccattttaagaatatattgctgtttatcctattgatggatatttgtattttttatacttttgtgtaataataaaaatactgctgt

SEQ ID NO: 202988 - DNA, 2042 bp, Homo sapiens
  Payload ID: 20031
  Gene Name: zinc finger protein 567
  ENST ID: ENST00000588311
  CDS Start-End: 141-1919
agactgctgtgctagcaatcagcgagactccgtgggcataggaccctccgagccagggatcagtgtctttcaatgatgtgactgtggacttcactcaggaggagtggcagcacctggatcatgctcagaagactctatatatggatgtgatgttggaaaactattgccacctcatctctgtggggtgtcacatgaccaaacctgatgtgatcctcaagttggaacgaggagaagagccatggacatcatttgcaggtcatacctgcttggaagaaaactggaaagctgaagactttttagtgaaattcaaggaacaccaagagaagtattctagatcagttgtaagcatcaaccacaaaaaactggtgaaggagaagagtaaaatatatgaaaagacatttactctaggcaaaaaccctgtgaattcaaaaaatctacctcctgaatatgatactcatggaaggattttgaaaaatgtttcagaattaatcatcagtaatctaaatcctgcaagaaagagacttagtgagtataatggatatgggaaatcactcctgagtactaaacaagagactactcatcctgaagtcaaatcccataatcaaagtgccagagctttcagtcataatgaagttcttatgcagtatcagaaaacggaaactccagcacagtcatttggatataatgactgtgagaaatcattccttcaaaggggaggcctgattacacatagtagaccttacaaaggagaaaacccatctgtatataataaaaaaagaagagcaaccaatattgaaaaaaaacatacatgcaatgaatgtgggaaatctttctgcaggaaatcagtattgattctgcatcagggaattcactcagaagaaaaaccctatcaatgtcatcaatgtggaaatgcatttagaaggaaatcatatctcattgatcatcagagaactcacacaggagagaaaccctttgtttgcaatgaatgtggtaagtccttccgcctcaagacagccctcactgatcatcagagaacacacacaggggagaaatcgtatgaatgtctgcaatgtaggaatgccttcagattgaagtcacacctcattcgtcatcagagaactcacacgggagagaaaccatatgagtgtaatgactgtgggaagtccttccgccagaagacaacactctctctacatcagagaatccatacaggtgagaaaccctacatttgtaaagaatgtgggaagtcctttcaccagaaggcaaatcttactgtacatcagagaactcatacaggggaaaagccctatatttgtaatgaatgtgggaaatccttctcccagaagacaacccttgctcttcatgagaaaactcataatgaggagaaaccctatatttgtagtgaatgtggaaagtccttccgccagaagacaacccttgtagcacatcagagaacacatacaggggagaaatcttatgaatgtcctcactgtgggaaggcctttagaatgaagtcatacctcattgatcatcaccgaactcacacaggagagaaaccatatgaatgtaatgaatgtggtaaatcattcagtcaaaagacaaatctcaatctacatcagagaattcatacaggggagaaaccctatgtttgtaatgaatgtgggaagtcctttcgccagaaagcaaccctcactgtacatcagaaaatacataccggccagaaatcctatgaatgtcctcagtgtgggaaagcctttagcaggaagtcatatctcattcatcatcaaagaactcatacgggagagaaaccatataaatgtagtgaatgtggaaagtgcttccgccagaagacaaatcttattgtacatcagagaactcacacaggtggagaggatggcctaactggatgtttatcctagcgtcaacccaccaaagatttggggaacatgtgagtcacattctctgggacattctactcccctttgattttgcatttccagacatttcagtggctaccacaaaaaataaaaagtatctgtggc

SEQ ID NO: 202989 - DNA, 483 bp, Homo sapiens
  Payload ID: 20031
  Gene Name: zinc finger protein 567
  ENST ID: ENST00000591308
  CDS Start-End: 1-153
ttggaaaactattgccacctcatctctgtggggtgtcacatgaccaaacctgatgtgatcctcaagttggaacgaggagaagagccatggacatcatttgcaggtcatacctgcttgggtggagaggatggcctaactggatgtttatcctagcgtcaacccaccaaagatttggggaacatatggagtctcacttcttcacccaggctggagtacaatggtgcgatctcggctgactgcaacctctgcctcccgggttcaagcaattctcctgcctcagcctcccaagtagctgggattacaggcacccattaccatgcccggctaaatttttgtatttttagtagagatggggtttcactgtgttagccaggatggtctcgatctcctgacctcatgatccgcctgcctcggcctcccaaagtactgggattacaggtgtgaaccaccgcgcccggccttgcaattcttatctagacgttt

SEQ ID NO: 202990 - DNA, 2441 bp, Homo sapiens
  Payload ID: 20032
  Gene Name: zinc finger protein 568
  Uniprot ID: Q3ZCX4
  ENST ID: ENST00000333987
  CDS Start-End: 507-2441
ggaaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaataggtcctggttccacaaggataaaacacatctgcagtgcaaatagaagtctgaggaacaggtgtcttatcatggaaggagacctgacctgagacctgccttagaggctggagagtcctgaaagagagtggaccctggagttgctggagcttgtcttgacccttctgcccagagcaggcagggtctgaatgacatctcaatcttcagtgatcagcaatagctgtgtgacaatggagcgtttgagccacatgatggaaaggaaagcttggtgttctcaagagtctgccctttccgaggaagaagaggatacaaccaggcctcttgaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaagtttgggaagttgatgaacagatcaagaagcaacaggaaacacttgtgaggaaagtcacatccatctccaagaaaattctgataaaggaaaaagtcattgaatgtaaaaaagttgcgaaaatatttcctctgagttcagacattgttacttcaagacaaagcttctatgactgtgactcacttgataagggtttggaacataatttagacttacttagatatgagaaaggctgtgtaagagagaaacagagtaatgagtttgggaaaccattttaccattgtgcatcctatgttgtaaccccctttaagtgtaatcagtgtggacaagacttcagtcataaatttgacctcattagacatgagcgaattcatgctggagagaaaccttacgaatgtaaagaatgtggaaaagccttcagtaggaaggaaaatcttattacacatcagaaaattcatactggggaaaaaccgtataagtgtaatgaatgtggaaaagctttcattcagatgtcaaaccttattagacaccacagaattcatactggggagaaaccttatgcatgtaaggattgttggaaagccttcagtcagaaatcaaatctcattgaacatgagcgaattcacactggagagaaaccctatgaatgtaaggaatgtgggaaatccttcagccagaagcaaaatcttattgagcacgagaaaattcatactggggagaaaccttatgcatgtaatgaatgtggtagagctttttctcgaatgtcatctgttacgctacatatgagaagtcacacaggggagaaaccctataaatgtaataaatgtggaaaagctttctctcaatgctcagtatttattatacatatgagaagtcacactggtgagaaaccctatgtatgtagtgaatgtgggaaagccttctctcagagttcatccctaaccgtacatatgcgaaatcatacagctgagaaaccctatgaatgtaaggaatgtggaaaagccttcagcaggaaagaaaatctcattacacatcagaaaattcacactggagagaaaccttatgaatgcagtgaatgtgggaaagcttttattcagatgtcaaacctcattcgacaccagagaattcatacgggtgagaaaccctatgcatgtacagtatgtggaaaagcctttagtcagaaatcaaacctcactgaacatgagaaaattcatactggagagaaaccttatcattgtaatcaatgtgggaaagctttcagtcagagacaaaatcttcttgagcatgaaaaaattcatactggagagaaaccattcaaatgtaatgaatgtggtaaagccttctctcgaatctcatccctcactcttcatgtgagaagtcacacaggggagaaaccctatgaatgtaataaatgtgggaaagccttttctcagtgctcattacttattatacatatgagaagtcatactggtgagaaaccctttgaatgtaatgaatgtgggaaagcattctctcaaagagcatccctttctatacataagagaggtcatacaggtgagagacaccaagtatattaa

SEQ ID NO: 202991 - DNA, 2232 bp, Homo sapiens
  Payload ID: 20032
  Gene Name: zinc finger protein 568
  ENST ID: ENST00000444991
  CDS Start-End: 484-2232
atggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaataggtcctggttccacaaggataaaacacatctgcagtgcaaatagaagtctgaggaacaggtgtcttatcatggaaggagacctgacctgagacctgccttagaggctggagagtcctgaaagagagtggaccctggagttgctggagcttgtcttgacccttctgcccagagcaggcagggtctgaatgacatctcaatcttcagtgatcagcaatagctgtgtgacaatggagcgtttgagccacatgatggaaaggaaagcttggtgttctcaagagtctgccctttccgaggaagaagaggatacaaccaggcctcttgaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaacccagaagaggagagaactgctgtgcgtctgaagtgatggcggagggcttgaagttcaaagatgtggtcatttacttctctcaaaaggagtgggaatgcttgcactctgctcagaaggatttgtaccgagatgtaatgttggaaaattacggcaacctggtcttactggggctttctgatactaagccaaatgtgatctccttattggagcagaagaaagagccctggatggttaagaggaaggagacaaaagaatggtgtccagattgggagtttggaagagaaaccaagaatttatctccaaaggaaaacatttatgaaattagatcaccacaacaggagaaggccagagttatcagagaaatcagatgccaggtggagagacaacagggtcatcaggagggacatttcagaccagctgtaataccatttacttccatgcagtgcacagcccatagagaatatcagtggcttcatactggagagaaatcctgtgaatgcaggaaatgtaagaatgcttttaggtaccagtcatgtcctattcaacatgaaataattcataataaggaaaaagaacctgaatgtggagaatgtaggaaaatctttaatagtggatcagacttgattaagcatcagacgcttcatgaaagcaaaaaacatagtgaaaataacaaatgtgcctttaatcatgattctggaattactcaacctcagagcattaatactggagagaaacctcataaatgtaaggaatgtgggaaagcctttcgttccagctcacaaattagtcagcatcagaggatgcatcttggtgagaaaccctataagtgtagggagtgtgggaaagcctttccatccactgcacagcttaatctacatcagaggatccatactgatgagaaatactatgaaagtaaggcgtgtgggaaggcctttacccgtccctcacacctttttcgacatcaaagaatccatacgggtgagaaaccccataaatgtaaggaatgtggaaaggcttttcgttatgacacacagctgagccttcatcagataatccatactggtgaaagacgctatgaatgcagggagtgtggaaaggtgtacagttgtgcctcacagctgagtctacatcaaagaattcatactggtgagaaaccccatgaatgtaaggaatgtgggaaagcctttatctctgattcacatcttattcgacatcagagtgtccatactggggagaaaccctgtaagtgtaaggaatgtgggaagtcctttcgtcgtggctcagaacttacccgacatcagagagctcatactggtgaaaaaccctatgagtgtaaggaatgtgaaaaggcctttacttgtagcacagaacttgttcgacatcaaaaa

SEQ ID NO: 202992 - DNA, 3774 bp, Homo sapiens
  Payload ID: 20032
  Gene Name: zinc finger protein 568
  Uniprot ID: Q3ZCX4
  ENST ID: ENST00000415168
  CDS Start-End: 377-2119
aaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaataggaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaagtttgggaagttgatgaacagatcaagaagcaacaggaaacacttgtgaggaaagtcacatccatctccaagaaaattctgataaaggaaaaagtcattgaatgtaaaaaagttgcgaaaatatttcctctgagttcagacattgttacttcaagacaaagcttctatgactgtgactcacttgataagggtttggaacataatttagacttacttagatatgagaaaggctgtgtaagagagaaacagagtaatgagtttgggaaaccattttaccattgtgcatcctatgttgtaaccccctttaagtgtaatcagtgtggacaagacttcagtcataaatttgacctcattagacatgagcgaattcatgctggagagaaaccttacgaatgtaaagaatgtggaaaagccttcagtaggaaggaaaatcttattacacatcagaaaattcatactggggaaaaaccgtataagtgtaatgaatgtggaaaagctttcattcagatgtcaaaccttattagacaccacagaattcatactggggagaaaccttatgcatgtaaggattgttggaaagccttcagtcagaaatcaaatctcattgaacatgagcgaattcacactggagagaaaccctatgaatgtaaggaatgtgggaaatccttcagccagaagcaaaatcttattgagcacgagaaaattcatactggggagaaaccttatgcatgtaatgaatgtggtagagctttttctcgaatgtcatctgttacgctacatatgagaagtcacacaggggagaaaccctataaatgtaataaatgtggaaaagctttctctcaatgctcagtatttattatacatatgagaagtcacactggtgagaaaccctatgtatgtagtgaatgtgggaaagccttctctcagagttcatccctaaccgtacatatgcgaaatcatacagctgagaaaccctatgaatgtaaggaatgtggaaaagccttcagcaggaaagaaaatctcattacacatcagaaaattcacactggagagaaaccttatgaatgcagtgaatgtgggaaagcttttattcagatgtcaaacctcattcgacaccagagaattcatacgggtgagaaaccctatgcatgtacagtatgtggaaaagcctttagtcagaaatcaaacctcactgaacatgagaaaattcatactggagagaaaccttatcattgtaatcaatgtgggaaagctttcagtcagagacaaaatcttcttgagcatgaaaaaattcatactggagagaaaccattcaaatgtaatgaatgtggtaaagccttctctcgaatctcatccctcactcttcatgtgagaagtcacacaggggagaaaccctatgaatgtaataaatgtgggaaagccttttctcagtgctcattacttattatacatatgagaagtcatactggtgagaaaccctttgaatgtaatgaatgtgggaaagcattctctcaaagagcatccctttctatacataagagaggtcatacaggtgagagacaccaagtatattaaatgaaagaaggcctcttaaattcaacccatgttttacttaaaatatcttggcataagctcaaaaaagccaggatctttatggaaaaattttaatactttgttaaaaggtgtaagactggaataaatggaaagaaataccatatacatagatggaaaaacccagtattataaaaacctcaattctgaaaatctatagactgaatgcagttccaaacaaaatcaactaagaattttctaggatctttcaaaaatgattataaaattcatgtgaaatagaagtgtatgaattgctgcgacaattttgaaaagaatagaggaaacaccctcactgtatgatataaagttatagtcatttaaaaatgtgtgatattagtacattagtaggtaaatgagcagattttaaagaatagaatatccagaagcagattcatgaatatatgtgaactcagtgtatgttagacctgacatcatgaattagtagggaaatgatgacctagtcaataaaattgctgggaatatttgactctccgtattggagaaaataaaattacaacattacgacatactaaaaaatcaatattcttttttttttttttttttttttgagacaagcgtctcactctgtcgcccaggctggagtacggtggtgcaatctcagctcactgcagcctctgctttccgggtttttttgttttgttttgttttgttttttgtatttttagtagagacggggtttcaccatgttggccagggtagtcttgaactcctgacttcaaaagtgatcgccctctttggcctcccaaagtgctggggtttacaggcttgagccactgcacctggccaaaaaattaacattctaaaggatttaaatactggaatttgaaaagccaaactgtgaaaccattgggagaaaatagatgatattgtctatgacgttgaggccaaggagctttttttttttttttttcaagacaaaaggactctgtaattccacttctaggtatatatacatcctatagaaactcacaaataatgcataagaaatatatatataatatatgtatgtatgtatagccagatgcagtggcacatgcctgtaatcccagctacttgggaggctgatagaagaagataacttgaggtcaggagttcaagaccagcctgggaaacatagcaagaccccatctcttaaaaaaaaagaaatatatagacatatatctgcattgaaaacaacctaaatattcatcagtggggtaatggatgaataaaatatgatatattcaaatgatagaatagtatacagcacttaaaagcagtgaaccagatccatattgtgtaacatggatagttaaaacaatgttgaatgaaaaaaatcaaaatacaaatgaaacattgtgtaataatatttatgtaaattggaatgaaatcatttataaagaacaactgtttctattattgaaaattgtatgtaaaactatttaaaatagaatagaaggatacacacccaattattgatagcattgtctctggagattgaatttgaggctgttgattaaaaggagactttagctttgcttgtagtttttataccttaaaaagactggtagcatataaaataaatcttaaaagctaattatacacaatgacaatatgaa

SEQ ID NO: 202993 - DNA, 1725 bp, Homo sapiens
  Payload ID: 20032
  Gene Name: zinc finger protein 568
  ENST ID: ENST00000433993
  CDS Start-End: 578-1725
ttggaaagcaaagggctggaacgtcccgggctgcggagctcgctgggttgggatggactcgttcagacctgagtgctaggacgccgaagggggcggtgaggcgtcccggcgaggagctggggtcgtctggagtttaaaagacaggtggctctcggagatgtgcgggctgcatgcccacgcttcaccgctaggggaggtcagggctgtgcgatggggaaggaagagagtgtcggggcggtgcagtcgggatgggagaagggtgtcagggccactggcccccagctcggcagagggcagtgtcgggccgcgcgcaggcagggagtgggtgtggtgtgaggctggcgctggagcggtctgggaatgttaggaggtctagggtatcgcggccctgcgtcctcttgtctggactaaaagtccgggcagttctccccggacctggattgtgggcccagcgacaggtgcttggcgatctgtgcccgctgtgcctgcggggctgtggtgggagtcctgtctgcacggtattctgtgtggctgtgcataacccagaagaggagagaactgctgtgcgtctgaagtgatggcggagggcttgaagttcaaagatgtggtcatttacttctctcaaaaggagtgggaatgcttgcactctgctcagaaggatttgtaccgagatgtaatgttggaaaattacggcaacctggtcttactggggctttctgatactaagccaaatgtgatctccttattggagcagaagaaagagccctggatggttaagaggaaggagacaaaagaatggtgtccagattgggagtttggaagagaaaccaagaatttatctccaaaggaaaacatttatgaaattagatcaccacaacaggagaaggccagagttatcagagaaatcagatgccaggtggagagacaacagggtcatcaggagggacatttcagaccagctgtaataccatttacttccatgcagtgcacagcccatagagaatatcagtggcttcatactggagagaaatcctgtgaatgcaggaaatgtaagaatgcttttaggtaccagtcatgtcctattcaacatgaaataattcataataaggaaaaagaacctgaatgtggagaatgtaggaaaatctttaatagtggatcagacttgattaagcatcagacgcttcatgaaagcaaaaaacatagtgaaaataacaaatgtgcctttaatcatgattctggaattactcaacctcagagcattaatactggagagaaacctcataaatgtaaggaatgtgggaaagcctttcgttccagctcacaaattagtcagcatcagaggatgcatcttggtgagaaaccctataagtgtagggagtgtgggaaagcctttccatccactgcacagcttaatctacatcagaggatccatactgatgagaaatactatgaaagtaaggcgtgtgggaaggcctttacccgtccctcacacctttttcgacatcaaagaatccatacgggtgagaaaccccataaatgtaaggaatgtggaaaggcttttcgttatgacacacagctgagccttcatcagataatccatactggtgaaagacgctatgaatgcagggagtgtggaaaggtgtacagttgtgcctcacagctgagtctacatcaaagaattcatactggtgagaaaccccatgaatgtaaggaatgtgggaaagc

SEQ ID NO: 202994 - DNA, 1827 bp, Homo sapiens
  Payload ID: 20032
  Gene Name: zinc finger protein 568
  ENST ID: ENST00000427117
  CDS Start-End: 519-1034
ggtgttgtcctcggaaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaataggtcctggttccacaaggataaaacacatctgcagtgcaaatagaagtctgaggaacaggtgtcttatcatggaaggagacctgacctgagacctgccttagaggctggagagtcctgaaagagagtggaccctggagttgctggagcttgtcttgacccttctgcccagagcaggcagggtctgaatgacatctcaatcttcagtgatcagcaatagctgtgtgacaatggagcgtttgagccacatgatggaaaggaaagcttggtgttctcaagagtctgccctttccgaggaagaagaggatacaaccaggcctcttgaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaacccagaagaggagagaactgctgtgcgtctgaagtgatggcggagatggagttttgcccttgttgcccaggctggagtgcaatggcgcgatctcagctcaccgcaacctctgcctcccgagttgaagtgattctcctgcctcagcctcccgagtagctgggattacaggcatgtgtcaccacacccagctaatttagtgttttttatagagacggggtttctccatgttggtcaggctggtctcaaactcccgacctcaggtgatccgcctgccttggcctcccaaagtgctgggattacaggtgtgaaccaccgcacctggcctttaactgtctttttaaaactgctttttattaaatattgaatagtagaacatgtgtaatatattaagggggactgaacacccatgttaagaggtagaatgctaatgttagaaatcccatgtgtgctttgatcttcccaatctaaatccccttctttagctgtcagaggtatctgttattccgaatcttgtgtttggcatttccttgtttttctttacagtcttaaccatatgtgtttattttcctgttctaatttgatgtcaagaaatcatactgtttggatttttctgcaactctattacttgtcctccaacgagtgttcaagagatccattcacattgcaaacttatcctactgtatagccatccattgtaagaatacattttttcatttatattgtgtacattactccagtgaacattcttgaactcctctttttgtatcctgtgcaagaatttctgtatgtaactaaaaaaggaattgctagctcataggttatatgcattttcagccttactcaacattgcccagttgttttctaaagtgtttattatactcatttactattccttttacttcgtatcctcaccaacacttggtattattaaattttaaatttttacgca

SEQ ID NO: 202995 - DNA, 561 bp, Homo sapiens
  Payload ID: 20032
  Gene Name: zinc finger protein 568
  ENST ID: ENST00000455817
  CDS Start-End: 323-561
gggtgtggtgtgaggctggcgctggagcggtctgggaatgttaggaggtctagggtatcgcggccctgcgtcctcttgtctggactaaaagtccgggcagttctccccggacctggattgtgggcccagcgacaggtgcttggcgatctgtgcccgctgtgcctgcggggctgtggtgggagtcctgtctgcacggtattctgtgtggctgtgcataacccagaagaggagagaactgctgtgcgtctgaagtgatggcggagggctttctgatactaagccaaatgtgatctccttattggagcagaagaaagagccctggatggttaagaggaaggagacaaaagaatggtgtccagattgggagtttggaagagaaaccaagaatttatctccaaaggaaaacatttatgaaattagatcaccacaacaggagaaggccagagttatcagagaaatcagatgccaggtggagagacaacagggtcatcaggagggacatttcagaccagctgtaataccatttacttccatgcagtgcacagcccatagagaatatca

SEQ ID NO: 202996 - DNA, 2378 bp, Homo sapiens
  Payload ID: 20032
  Gene Name: zinc finger protein 568
  Uniprot ID: Q3ZCX4
  ENST ID: ENST00000455427
  CDS Start-End: 330-2045
attcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaatagcttggtgttctcaagagtctgccctttccgaggaagaagaggatacaaccaggcctcttgaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaacccagaagaggagagaactgctgtgcgtctgaagtgatggcggagggcttgaagttcaaagatgtggtcatttacttctctcaaaaggagtgggaatgcttgcactctgctcagaaggatttgtaccgagatgtaatgttggaaaattacggcaacctggtcttactggggctttctgatactaagccaaatgtgatctccttattggagcagaagaaagagccctggatggttaagaggaaggagacaaaagaatggtgtccagattgggagtttggaagagaaaccaagaatttatctccaaaggaaaacatttatgaaattagatcaccacaacaggagaaggccagagttatcagagaaatcagatgccaggtggagagacaacagggtcatcaggagggacatttcagaccagctgtaataccatttacttccatgcagtgcacagcccatagagaatatcagtggcttcatactggagagaaatcctgtgaatgcaggaaatgtaagaatgcttttaggtaccagtcatgtcctattcaacatgaaataattcataataaggaaaaagaacctgaatgtggagaatgtaggaaaatctttaatagtggatcagacttgattaagcatcagacgcttcatgaaagcaaaaaacatagtgaaaataacaaatgtgcctttaatcatgattctggaattactcaacctcagagcattaatactggagagaaacctcataaatgtaaggaatgtgggaaagcctttcgttccagctcacaaattagtcagcatcagaggatgcatcttggtgagaaaccctataagtgtagggagtgtgggaaagcctttccatccactgcacagcttaatctacatcagaggatccatactgatgagaaatactatgaaagtaaggcgtgtgggaaggcctttacccgtccctcacacctttttcgacatcaaagaatccatacgggtgagaaaccccataaatgtaaggaatgtggaaaggcttttcgttatgacacacagctgagccttcatcagataatccatactggtgaaagacgctatgaatgcagggagtgtggaaaggtgtacagttgtgcctcacagctgagtctacatcaaagaattcatactggtgagaaaccccatgaatgtaaggaatgtgggaaagcctttatctctgattcacatcttattcgacatcagagtgtccatactggggagaaaccctgtaagtgtaaggaatgtgggaagtcctttcgtcgtggctcagaacttacccgacatcagagagctcatactggtgaaaaaccctatgagtgtaaggaatgtgaaaaggcctttacttgtagcacagaacttgttcgacatcaaaaagttcacactggggagagaccccataagtgtaaggaatgtgggaaggctttcattcgaaggtcagaactcacacatcatgagagaagtcacactggtgagaaaccctacgagtgtaaggagtgtgggaagccctttggtggtggctcagaacttagttgacaccagaaaattcatactggtgagaaaccatatgaatgtcagcagtgtggaaaggccttcattcgggcctcacaccttagtcaacatcaaagaattcattcaggacagaggagtgaatgaagaaatgagggatggctcagaatttgattgacatgagaaagttcatactgatttggaaaaaaaaacttatgattctaagtgtgagacaccttataaatgttaggaattagcagggatttatttatgtttcagaatttattacacatcatgatacaactggtgaaaaattgaagacctccatgaatgtaaagaaagtagggaggcctttttggt

SEQ ID NO: 202997 - DNA, 1902 bp, Homo sapiens
  Payload ID: 20032
  Gene Name: zinc finger protein 568
  ENST ID: ENST00000586353
  CDS Start-End: 580-699
tgttggaaagcaaagggctggaacgtcccgggctgcggagctcgctgggttgggatggactcgttcagacctgagtgctaggacgccgaagggggcggtgaggcgtcccggcgaggagctggggtcgtctggagtttaaaagacaggtggctctcggagatgtgcgggctgcatgcccacgcttcaccgctaggggaggtcagggctgtgcgatggggaaggaagagagtgtcggggcggtgcagtcgggatgggagaagggtgtcagggccactggcccccagctcggcagagggcagtgtcgggccgcgcgcaggcagggagtgggtgtggtgtgaggctggcgctggagcggtctgggaatgttaggaggtctagggtatcgcggccctgcgtcctcttgtctggactaaaagtccgggcagttctccccggacctggattgtgggcccagcgacaggtgcttggcgatctgtgcccgctgtgcctgcggggctgtggtgggagtcctgtctgcacggtattctgtgtggctgtgcataacccagaagaggagagaactgctgtgcgtctgaagtgatggcggagatggagttttgcccttgttgcccaggctggagtgcaatggcgcgatctcagctcaccgcaacctctgcctcccgagttgaagtgattctcctgcctcagcctcccgagtagctgggattacaggcatgtgtcaccacacccagctaatttagtgttttttatagagacggggtttctccatgttggtcaggctggtctcaaactcccgacctcaggtgatccgcctgccttggcctcccaaagtgctgggattacaggtgtgaaccaccgcacctggcctttaactgtctttttaaaactgctttttattaaatattgaatagtagaacatgtgtaatatattaagggggactgaacacccatgttaagaggtagaatgctaatgttagaaatcccatgtgtgctttgatcttcccaatctaaatccccttctttagctgtcagaggtatctgttattccgaatcttgtgtttggcatttccttgtttttctttacagtcttaaccatatgtgtttattttcctgttctaatttgatgtcaagaaatcatactgtttggatttttctgcaactctattacttgtcctccaacgagtgttcaagagatccattcacattgcaaacttatcctactgtatagccatccattgtaagaatacattttttcatttatattgtgtacattactccagtgaacattcttgaactcctctttttgtatcctgtgcaagaatttctgtatgtaactaaaaaaggaattgctagctcataggttatatgcattttcagccttactcaacattgcccagttgttttctaaagtgtttattatactcatttactattccttttacttcgtatcctcaccaacacttggtattattaaattttaaatttttacgcacttgggtatgagttgatatgtattattttgatttcaaatttgcatattttggtactaaatgaggttgagccccccacccccgcaactttcatgctcattggcattcatgttttctcttttctgaagtacaattttatgtcatttctaatttttctattgatttttatatttccagagtttttgttccttttaatgctttgtatgcatttcttaaatattgtggattgtcgtccttgccggttatatgtgctgtgcatgctttcttactttaacctttaaatgatggtagatattctcaattttaatgccttcaaatttaatgctgttttctttaatttatttacatcttgtgtatgaaatctctcctctcctaagagtaaagatattatccctattttctataaatgata

SEQ ID NO: 202998 - DNA, 308 bp, Homo sapiens
  Payload ID: 20032
  Gene Name: zinc finger protein 568
  ENST ID: ENST00000592567
  CDS Start-End: 232-308
gaaagcaaagggctggaacgtcccgggctgcggagctcgctgggttgggatggactcgttcagacctgagtgctaggacgccgaagggggcggtgaggcgtcccggcgaggagctggggtcgtctggagtttaaaagacaggtggctctcggagatgtgcgggctgcatgcccacgcttcaccgctaggggagaacccagaagaggagagaactgctgtgcgtctgaagtgatggcggagggcttgaagttcaaagatgtggtcatttacttctctcaaaaggagtgggaatgcttgcactctgctca

SEQ ID NO: 202999 - DNA, 516 bp, Homo sapiens
  Payload ID: 20032
  Gene Name: zinc finger protein 568
  ENST ID: ENST00000588596
  CDS Start-End: 341-516
ggagcggtctgggaatgttaggaggtctagggtatcgcggccctgcgtcctcttgtctggactaaaagtccgggcagttctccccggacctggattgtgggcccagcgacaggtgcttggcgatctgtgcccgctgtgcctgcggggctgtggtgggagtcctgtctgcacggtattctgtgtggctgtgcataacccagaagaggagagaactgctgtgcgtctgaagtgatggcggagatgtgatcttgtttaatccacataacaaccctattagacagggctttctgatactaagccaaatgtgatctccttattggagcagaagaaagagccctggatggttaagaggaaggagacaaaagaatggtgtccagattgggagtttggaagagaaaccaagaatttatctccaaaggaaaacatttatgaaattagatcaccacaacaggagaaggccagagttatcagagaaatcagatgccaggtggagagacaacagggtcatcaggaggg

SEQ ID NO: 203000 - DNA, 1914 bp, Homo sapiens
  Payload ID: 20032
  Gene Name: zinc finger protein 568
  ENST ID: ENST00000587857
  CDS Start-End: 324-1914
gtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaatagcttggtgttctcaagagtctgccctttccgaggaagaagaggatacaaccaggcctcttgaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaagtttgggaagttgatgaacagatcaagaagcaacaggaaacacttgtgaggaaagtcacatccatctccaagaaaattctgataaaggaaaaagtcattgaatgtaaaaaagttgcgaaaatatttcctctgagttcagacattgttacttcaagacaaagcttctatgactgtgactcacttgataagggtttggaacataatttagacttacttagatatgagaaaggctgtgtaagagagaaacagagtaatgagtttgggaaaccattttaccattgtgcatcctatgttgtaaccccctttaagtgtaatcagtgtggacaagacttcagtcataaatttgacctcattagacatgagcgaattcatgctggagagaaaccttacgaatgtaaagaatgtggaaaagccttcagtaggaaggaaaatcttattacacatcagaaaattcatactggggaaaaaccgtataagtgtaatgaatgtggaaaagctttcattcagatgtcaaaccttattagacaccacagaattcatactggggagaaaccttatgcatgtaaggattgttggaaagccttcagtcagaaatcaaatctcattgaacatgagcgaattcacactggagagaaaccctatgaatgtaaggaatgtgggaaatccttcagccagaagcaaaatcttattgagcacgagaaaattcatactggggagaaaccttatgcatgtaatgaatgtggtagagctttttctcgaatgtcatctgttacgctacatatgagaagtcacacaggggagaaaccctataaatgtaataaatgtggaaaagctttctctcaatgctcagtatttattatacatatgagaagtcacactggtgagaaaccctatgtatgtagtgaatgtgggaaagccttctctcagagttcatccctaaccgtacatatgcgaaatcatacagctgagaaaccctatgaatgtaaggaatgtggaaaagccttcagcaggaaagaaaatctcattacacatcagaaaattcacactggagagaaaccttatgaatgcagtgaatgtgggaaagcttttattcagatgtcaaacctcattcgacaccagagaattcatacgggtgagaaaccctatgcatgtacagtatgtggaaaagcctttagtcagaaatcaaacctcactgaacatgagaaaattcatactggagagaaaccttatcattgtaatcaatgtgggaaagctttcagtcagagacaaaatcttcttgagcatgaaaaaattcatactggagagaaaccattcaaatgtaatgaatgtggtaaagccttctctcgaatctcatccctcactcttcatgtgagaagtcacacaggggagaaaccctatgaatgtaataaatgtgggaaagcct

SEQ ID NO: 203001 - DNA, 552 bp, Homo sapiens
  Payload ID: 20032
  Gene Name: zinc finger protein 568
  ENST ID: ENST00000587130
  CDS Start-End: 531-552
ggaaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaatagcttggtgttctcaagagtctgccctttccgaggaagaagaggatacaaccaggcctcttagatggagtctcactatgttaccaaggctgttctcgaactcctggcctcaagcagtcctcctgcctcagcctcccaaagtgctacgattataggaaacagtgacatttaaggatgtggctgttgaccttacccaggaggagtgggagcaaatgaaacctgctcaaagaaact

SEQ ID NO: 203002 - DNA, 3542 bp, Homo sapiens
  Payload ID: 20032
  Gene Name: zinc finger protein 568
  ENST ID: ENST00000616085
  CDS Start-End: 149-1282
ccctgagtaccagctaaacaagttcttgtatgttgtgatcacaatgcctaattttgatgacttcaaattaattagcattatgtttttacaggaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaagtttgggaagttgatgaacagatcaagaagcaacaggaaacacttgtgaggaaagtcacatccatctccaagaaaattctgataaaggaaaaagtcattgaatgtaaaaaagttgcgaaaatatttcctctgagttcagacattgttacttcaagacaaagcttctatgactgtgactcacttgataagggtttggaacataatttagacttacttagatatgagaaaggctgtgtaagagagaaacagagtaatgagtttgggaaaccattttaccattgtgcatcctatgttgtaaccccctttaagtgtaatcagtgtggacaagacttcagtcataaatttgacctcattagacatgagcgaattcatgctggagagaaaccttacgaatgtaaagaatgtggaaaagccttcagtaggaaggaaaatcttattacacatcagaaaattcatactggggaaaaaccgtataagtgtaatgaatgtggaaaagctttcattcagatgtcaaaccttattagacaccacagaattcatactggggagaaaccttatgcatgtaaggattgttggaaagccttcagtcagaaatcaaatctcattgaacatgagcgaattcacactggagagaaaccctatgaatgtaaggaatgtgggaaatccttcagccagaagcaaaatcttattgagcacgagaaaattcatactggggagaaaccttatgcatgtaatgaatgtggtagagctttttctcgaatgtcatctgttacgctacatatgagaagtcacacaggggagaaaccctataaatgtaataaatgtggaaaagctttctctcaatgctcagtatttattatacatatgagaagtcacactggtgagaaaccctatgtatgtagtgaatgtgggaaagccttctctcagagttcatccctaaccgtacatgcgaaatcatacagctgagaaaccctatgaatgtaaggaatgtggaaaagccttcagcaggaaagaaaatctcattacacatcagaaaattcacactggagagaaaccttatgaatgcagtgaatgtgggaaagcttttattcagatgtcaaacctcattcgacaccagagaattcatacgggtgagaaaccctatgcatgtacagtatgtggaaaagcctttagtcagaaatcaaacctcactgaacatgagaaaattcatactggagagaaaccttatcattgtaatcaatgtgggaaagctttcagtcagagacaaaatcttcttgagcatgaaaaaattcatactggagagaaaccattcaaatgtaatgaatgtggtaaagccttctctcgaatctcatccctcactcttcatgtgagaagtcacacaggggagaaaccctatgaatgtaataaatgtgggaaagccttttctcagtgctcattacttattatacatatgagaagtcatactggtgagaaaccctttgaatgtaatgaatgtgggaaagcattctctcaaagagcatccctttctatacataagagaggtcatacaggtgagagacaccaagtatattaaatgaaagaaggcctcttaaattcaacccatgttttacttaaaatatcttggcataagctcaaaaaagccaggatctttatggaaaaattttaatactttgttaaaaggtgtaagactggaataaatggaaagaaataccatatacatagatggaaaaacccagtattataaaaacctcaattctgaaaatctatagactgaatgcagttccaaacaaaatcaactaagaattttctaggatctttcaaaaatgattataaaattcatgtgaaatagaagtgtatgaattgctgcgacaattttgaaaagaatagaggaaacaccctcactgtatgatataaagttatagtcatttaaaaatgtgtgatattagtacattagtaggtaaatgagcagattttaaagaatagaatatccagaagcagattcatgaatatatgtgaactcagtgtatgttagacctgacatcatgaattagtagggaaatgatgacctagtcaataaaattgctgggaatatttgactctccgtattggagaaaataaaattacaacattacgacatactaaaaaatcaatattcttttttttttttttttttttttgagacaagcgtctcactctgtcgcccaggctggagtacggtggtgcaatctcagctcactgcagcctctgctttccgggtttttttgttttgttttgttttgttttttgtatttttagtagagacggggtttcaccatgttggccagggtagtcttgaactcctgacttcaaaagtgatcgccctctttggcctcccaaagtgctggggtttacaggcttgagccactgcacctggccaaaaaattaacattctaaaggatttaaatactggaatttgaaaagccaaactgtgaaaccattgggagaaaatagatgatattgtctatgacgttgaggccaaggagctttttttttttttttttcaagacaaaaggactctgtaattccacttctaggtatatatacatcctatagaaactcacaaataatgcataagaaatatatatataatatatgtatgtatgtatagccagatgcagtggcacatgcctgtaatcccagctacttgggaggctgatagaagaagataacttgaggtcaggagttcaagaccagcctgggaaacatagcaagaccccatctcttaaaaaaaaagaaatatatagacatatatctgcattgaaaacaacctaaatattcatcagtggggtaatggatgaataaaatatgatatattcaaatgatagaatagtatacagcacttaaaagcagtgaaccagatccatattgtgtaacatggatagttaaaacaatgttgaatgaaaaaaatcaaaatacaaatgaaacattgtgtaataatatttatgtaaattggaatgaaatcatttataaagaacaactgtttctattattgaaaattgtatgtaaaactatttaaaatagaatagaaggatacacacccaattattgatagcattgtctctggagattgaatttgaggctgttgattaaaaggagactttagctttgcttgtagtttttataccttaaaaagactggtagcatataaaataaatcttaaaagctaattatacacaatgacaatatg

SEQ ID NO: 203003 - DNA, 3797 bp, Homo sapiens
  Payload ID: 20032
  Gene Name: zinc finger protein 568
  Uniprot ID: Q3ZCX4
  ENST ID: ENST00000619231
  CDS Start-End: 210-2144
ttagatttatatcctaatccacaggtcctggttccacaaggataaaacacatctgcagtgcaaatagaagtctgaggaacaggtgtcttatcatggaaggagacctgacctgagacctgccttagaggctggagagtcctgaaagagagtggaccctggagttgctggagcttgtcttgacccttctgcccagagcaggcagggtctgaatgacatctcaatcttcagtgatcagcaatagctgtgtgacaatggagcgtttgagccacatgatggaaaggaaagcttggtgttctcaagagtctgccctttccgaggaagaagaggatacaaccaggcctcttgaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaagtttgggaagttgatgaacagatcaagaagcaacaggaaacacttgtgaggaaagtcacatccatctccaagaaaattctgataaaggaaaaagtcattgaatgtaaaaaagttgcgaaaatatttcctctgagttcagacattgttacttcaagacaaagcttctatgactgtgactcacttgataagggtttggaacataatttagacttacttagatatgagaaaggctgtgtaagagagaaacagagtaatgagtttgggaaaccattttaccattgtgcatcctatgttgtaaccccctttaagtgtaatcagtgtggacaagacttcagtcataaatttgacctcattagacatgagcgaattcatgctggagagaaaccttacgaatgtaaagaatgtggaaaagccttcagtaggaaggaaaatcttattacacatcagaaaattcatactggggaaaaaccgtataagtgtaatgaatgtggaaaagctttcattcagatgtcaaaccttattagacaccacagaattcatactggggagaaaccttatgcatgtaaggattgttggaaagccttcagtcagaaatcaaatctcattgaacatgagcgaattcacactggagagaaaccctatgaatgtaaggaatgtgggaaatccttcagccagaagcaaaatcttattgagcacgagaaaattcatactggggagaaaccttatgcatgtaatgaatgtggtagagctttttctcgaatgtcatctgttacgctacatatgagaagtcacacaggggagaaaccctataaatgtaataaatgtggaaaagctttctctcaatgctcagtatttattatacatatgagaagtcacactggtgagaaaccctatgtatgtagtgaatgtgggaaagccttctctcagagttcatccctaaccgtacatatgcgaaatcatacagctgagaaaccctatgaatgtaaggaatgtggaaaagccttcagcaggaaagaaaatctcattacacatcagaaaattcacactggagagaaaccttatgaatgcagtgaatgtgggaaagcttttattcagatgtcaaacctcattcgacaccagagaattcatacgggtgagaaaccctatgcatgtacagtatgtggaaaagcctttagtcagaaatcaaacctcactgaacatgagaaaattcatactggagagaaaccttatcattgtaatcaatgtgggaaagctttcagtcagagacaaaatcttcttgagcatgaaaaaattcatactggagagaaaccattcaaatgtaatgaatgtggtaaagccttctctcgaatctcatccctcactcttcatgtgagaagtcacacaggggagaaaccctatgaatgtaataaatgtgggaaagccttttctcagtgctcattacttattatacatatgagaagtcatactggtgagaaaccctttgaatgtaatgaatgtgggaaagcattctctcaaagagcatccctttctatacataagagaggtcatacaggtgagagacaccaagtatattaaatgaaagaaggcctcttaaattcaacccatgttttacttaaaatatcttggcataagctcaaaaaagccaggatctttatggaaaaattttaatactttgttaaaaggtgtaagactggaataaatggaaagaaataccatatacatagatggaaaaacccagtattataaaaacctcaattctgaaaatctatagactgaatgcagttccaaacaaaatcaactaagaattttctaggatctttcaaaaatgattataaaattcatgtgaaatagaagtgtatgaattgctgcgacaattttgaaaagaatagaggaaacaccctcactgtatgatataaagttatagtcatttaaaaatgtgtgatattagtacattagtaggtaaatgagcagattttaaagaatagaatatccagaagcagattcatgaatatatgtgaactcagtgtatgttagacctgacatcatgaattagtagggaaatgatgacctagtcaataaaattgctgggaatatttgactctccgtattggagaaaataaaattacaacattacgacatactaaaaaatcaatattcttttttttttttttttttttttgagacaagcgtctcactctgtcgcccaggctggagtacggtggtgcaatctcagctcactgcagcctctgctttccgggtttttttgttttgttttgttttgttttttgtatttttagtagagacggggtttcaccatgttggccagggtagtcttgaactcctgacttcaaaagtgatcgccctctttggcctcccaaagtgctggggtttacaggcttgagccactgcacctggccaaaaaattaacattctaaaggatttaaatactggaatttgaaaagccaaactgtgaaaccattgggagaaaatagatgatattgtctatgacgttgaggccaaggagctttttttttttttttttcaagacaaaaggactctgtaattccacttctaggtatatatacatcctatagaaactcacaaataatgcataagaaatatatatataatatatgtatgtatgtatagccagatgcagtggcacatgcctgtaatcccagctacttgggaggctgatagaagaagataacttgaggtcaggagttcaagaccagcctgggaaacatagcaagaccccatctcttaaaaaaaaagaaatatatagacatatatctgcattgaaaacaacctaaatattcatcagtggggtaatggatgaataaaatatgatatattcaaatgatagaatagtatacagcacttaaaagcagtgaaccagatccatattgtgtaacatggatagttaaaacaatgttgaatgaaaaaaatcaaaatacaaatgaaacattgtgtaataatatttatgtaaattggaatgaaatcatttataaagaacaactgtttctattattgaaaattgtatgtaaaactatttaaaatagaatagaaggatacacacccaattattgatagcattgtctctggagattgaatttgaggctgttgattaaaaggagactttagctttgcttgtagtttttataccttaaaaagactggtagcatataaaataaatcttaaaagctaattatacacaatgacaatatg

SEQ ID NO: 203004 - DNA, 2441 bp, Homo sapiens
  Payload ID: 20032
  Gene Name: zinc finger protein 568
  ENST ID: ENST00000617745
  CDS Start-End: 201-2108
tatcctaatccacaggtcctggttccacaaggataaaacacatctgcagtgcaaatagaagtctgaggaacaggtgtcttatcatggaaggagacctgacctgagacctgccttagaggctggagagtcctgaaagagagtggaccctggagttgctggagcttgtcttgacccttctgcccagagcaggcagggtctgaatgacatctcaatcttcagtgatcagcaatagctgtgtgacaatggagcgtttgagccacatgatggaaaggaaagcttggtgttctcaagagtctgccctttccgaggaagaagaggatacaaccaggcctcttgaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaacccagaagaggagagaactgctgtgcgtctgaagtgatggcggagggcttgaagttcaaagatgtggtcatttacttctctcaaaaggagtgggaatgcttgcactctgctcagaaggatttgtaccgagatgtaatgttggaaaattacggcaacctggtcttactggggctttctgatactaagccaaatgtgatctccttattggagcagaagaaagagccctggatggttaagaggaaggagacaaaagaatggtgtccagattgggagtttggaagagaaaccaagaatttatctccaaaggaaaacatttatgaaattagatcaccacaacaggagaaggccagagttatcagagaaatcagatgccaggtggagagacaacagggtcatcaggagggacatttcagaccagctgtaataccatttacttccatgcagtgcacagcccatagagaatatcagtggcttcatactggagagaaatcctgtgaatgcaggaaatgtaagaatgcttttaggtaccagtcatgtcctattcaacatgaaataattcataataaggaaaaagaacctgaatgtggagaatgtaggaaaatctttaatagtggatcagacttgattaagcatcagacgcttcatgaaagcaaaaaacatagtgaaaataacaaatgtgcctttaatcatgattctggaattactcaacctcagagcattaatactggagagaaacctcataaatgtaaggaatgtgggaaagcctttcgttccagctcacaaattagtcagcatcagaggatgcatcttggtgagaaaccctataagtgtagggagtgtgggaaagcctttccatccactgcacagcttaatctacatcagaggatccatactgatgagaaatactatgaaagtaaggcgtgtgggaaggcctttacccgtccctcacacctttttcgacatcaaagaatccatacgggtgagaaaccccataaatgtaaggaatgtggaaaggcttttcgttatgacacacagctgagccttcatcagataatccatactggtgaaagacgctatgaatgcagggagtgtggaaaggtgtacagttgtgcctcacagctgagtctacatcaaagaattcatactggtgagaaaccccatgaatgtaaggaatgtgggaaagcctttatctctgattcacatcttattcgacatcagagtgtccatactggggagaaaccctgtaagtgtaaggaatgtgggaagtcctttcgtcgtggctcagaacttacccgacatcagagagctcatactggtgaaaaaccctatgagtgtaaggaatgtgaaaaggcctttacttgtagcacagaacttgttcgacatcaaaaagttcacactggggagagaccccataagtgtaaggaatgtgggaaggctttcattcgaaggtcagaactcacacatcatgagagaagtcacactggtgagaaaccctacgagtgtaaggagtgtgggaagccctttggtggtggctcagaacttagttgacaccagaaaattcatactggtgagaaaccatatgaatgtcagcagtgtggaaaggccttcattcgggcctcacaccttagtcaacatcaaagaattcattcaggacagaggagtgaatgaagaaatgagggatggctcagaatttgattgacatgagaaagttcatactgatttggaaaaaaaaacttatgattctaagtgtgagacaccttataaatgttaggaattagcagggatttatttatgtttcagaatttattacacatcatgatacaactggtgaaaaattgaagacctccatgaatgtaaagaaagtagggaggcctttttggt

SEQ ID NO: 203005 - DNA, 4061 bp, Homo sapiens
  Payload ID: 20033
  Gene Name: zinc finger protein 569
  Uniprot ID: Q5MCW4
  ENST ID: ENST00000316950
  CDS Start-End: 559-2619
gcagcggaacgattcgattcttctcagcaccaagttgcgctcccaatctctcagagctgggctcgcgggaggccgctcgtgcaaaacctaggctgagctcccctgcgcggagctgtgagccctggaacaccgtggtctgcttctcaggacgcgcaaacagtgaagccagtcccgcccgggtgagccgcgggggcctctgggaagcgtcgcccctggtgtaacggaccgagacttgtggcgctctcagccaccgacagcgccggcctcagtgccgcctctgtcccagcccgcgccggctctgccactttggcagcgttaagtgtggaatcggggcctgtgtccgcgggcttggtgagttcttcatatattaaggattcattcattcatagactcatttattgaaggctgtctgtgtaacaggcacaatcctaggtgcttgggatatagcagtgaacaagagacaaaccccctactatcatggtacttacatttttgtgggctggataataaacaagctctacttctgcaggccccatcccttcccagaaagaagaggaaatgactgagtcccagggaacagtaacattcaaagatgtggctatcgacttcactcaggaggagtggaagagattggatcctgctcagagaaaactgtaccggaatgtgatgctagaaaactataacaacttaatcacagtaggctatccgttcaccaaacctgatgtgattttcaaattggagcaagaagaagaaccatgggtgatggaggaagaagtattaaggagacactggcaaggagaaatatggggagttgatgagcatcagaaaaaccaggacagacttttgagacaagttgaagttaaattccagaaaacactgactgaagaaaaaggcaatgaatgtcaaaagaaatttgcaaatgtatttcctctgaactctgattttttcccttccagacacaatctctatgagtatgacttatttggaaagtgtttagaacataattttgactgtcataataatgtgaaatgccttatgagaaaggagcattgtgaatataatgaacctgtgaaatcatatggtaatagctcatcccattttgtcattaccccctttaagtgtaatcattgtggaaaaggcttcaatcagactttggacctcatcagacatctgagaattcatactggagagaagccctatgaatgtagtaactgtagaaaagccttcagtcacaaggaaaaacttattaaacattataaaattcacagtagggagcagtcttacaaatgtaatgaatgtggtaaagctttcattaaaatgtcaaatctcattagacatcaaagaattcatactggagagaagccctatgcatgtaaggaatgtgagaagtccttcagccagaaatcaaatcttattgatcatgaaaaaattcatactggagagaaaccttatgaatgtaatgagtgtggaaaagcattcagccagaagcaaagcctcattgcacatcagaaagttcatactggggagaaaccttatgcatgtaatgaatgtggtaaagccttccctcgaattgcatcccttgctcttcatatgagaagtcatacaggagaaaaaccttataaatgtgataaatgtggtaaagccttctctcagttttccatgcttattatacatgttagaattcatacaggtgaaaaaccctatgaatgtaatgagtgtggaaaagccttctctcaaagctcagcccttactgtacatatgagaagtcacactggtgagaaaccctatgaatgtaaggaatgcagaaaagccttcagccacaagaaaaacttcattacacaccagaaaattcatactagagagaaaccttatgagtgtaatgaatgtgggaaagcttttatacagatgtcaaatcttgttagacaccagagaattcatactggggaaaaaccctatatatgtaaggaatgtgggaaagcctttagccagaaatcaaatctcattgctcatgaaaaaattcattctggagagaaaccctatgaatgcaatgaatgtggtaaagccttcagccaaaagcaaaacttcattacacatcaaaaagttcatactggagagaaaccttatgattgtaatgaatgtggtaaagccttctctcaaattgcatcccttacccttcatttgagaagtcatacaggggaaaagccttatgaatgtgataaatgtggtaaagccttctctcagtgctcactgcttaatttacatatgagaagtcacacaggtgagaagccctatgtatgtaatgaatgtgggaaagccttctctcaaagaacttcccttattgtgcacatgagaggccatacaggtgaaaaaccctatgaatgtaataaatgtggaaaagccttctcccaaagctcatcccttactatacatatacgaggacatacaggtgagaaacccttcgactgtagtaaatgtggaaaagccttctctcaaatctcatctcttacccttcatatgagaaaacatacaggtgagaagccctatcactgtattgagtgtggcaaggctttcagccaaaagtcgcaccttgttagacaccagagaattcatactcattagaaaccctatgaatattgtgaatatggcaaggccatctgaaggaattaacacctcattgcacattacatgatcacttccagagtagaaaactatgaatgtgggatagccttctgaaaaagccacaaatttatgaaacattagagaattcttccaaggtgacaaattatataatgaaaaagctgttaccagaaactttcagcagacatcttattgataatatttaatcagcattctcattgaaatctgaaacaaggtatcttccatcagcataacaacacaacacttgagctcctagccaatgtattaagtaaggaaaacaagtatcaacgaagaactataaaaataacttttatacaagaaataattagaaaatgtgttgatagaaaacctaagaataaacacaacaatgagttaggtctttatcaagttataaaatatgttgaaaggcacaaaagaacacctgaaaaatgatattttgtctgaaaagacttgacattgtaaaaatataatttctctcccaaatcactaagtttaatatacttctgaagtttacatcagttttattttaaggaacttcacaaacttatccaaaaattttatgtggaaaagtaaagaaacacaaatagctgaaacaaacttgacaaagcaagtagagaagacacactctattattagatatatcatgtacttatttaaagctgctgtcatttaaacaatgtattaccaagtgaataaatcaagcagtagtaagatagtgagcattcatacaaaaatccaagaagatacaggaattctgtgtatgacagtgctattgaaatcactggggaatgaatggcttatttaataaatggaaggttcataggagaaaaattttagctttctactttatatcatatacaaaaataaaatccaactaaagaccagaatataaaaagcaaaattttaaaactatgatgaaagtagaatccgttactttagggtaacaagatttctttaaaaaacatgtaaacatggaatagtctgttgaattttggtgtattggcctcacaggcacccacaaatgtacacaaagagatatatatcactgtgttcctgaatcatggtttgtattgcccaaaattggatataacaaatttttatcaattgtggaatagatgaataagtgtgatcatttctgtgataaaatacagaatttagaaacaaaatctacctatagttatatggatagattacaatatataatattgagagaaaaaattaaaatgcacaaaggaacacagtataacatttgtataatttaataagatcttgcaaagaacagtactgtgtattggtcatggatccatatatgacttggttgccttttgggatgtgggaaaggtttggtgggagttgttatatttatctgtaatatttctttaataaaagagtgaaagcaaata

SEQ ID NO: 203006 - DNA, 3689 bp, Homo sapiens
  Payload ID: 20033
  Gene Name: zinc finger protein 569
  Uniprot ID: Q5MCW4
  ENST ID: ENST00000392149
  CDS Start-End: 187-2247
gcccctggtgtaacggaccgagacttgtggcgctctcagccaccgacagcgccggcctcagtgccgcctctgtcccagcccgcgccggctctgccactttggcagcgttaagtgtggaatcggggcctgtgtccgcgggcttgctctacttctgcaggccccatcccttcccagaaagaagaggaaatgactgagtcccagggaacagtaacattcaaagatgtggctatcgacttcactcaggaggagtggaagagattggatcctgctcagagaaaactgtaccggaatgtgatgctagaaaactataacaacttaatcacagtaggctatccgttcaccaaacctgatgtgattttcaaattggagcaagaagaagaaccatgggtgatggaggaagaagtattaaggagacactggcaaggagaaatatggggagttgatgagcatcagaaaaaccaggacagacttttgagacaagttgaagttaaattccagaaaacactgactgaagaaaaaggcaatgaatgtcaaaagaaatttgcaaatgtatttcctctgaactctgattttttcccttccagacacaatctctatgagtatgacttatttggaaagtgtttagaacataattttgactgtcataataatgtgaaatgccttatgagaaaggagcattgtgaatataatgaacctgtgaaatcatatggtaatagctcatcccattttgtcattaccccctttaagtgtaatcattgtggaaaaggcttcaatcagactttggacctcatcagacatctgagaattcatactggagagaagccctatgaatgtagtaactgtagaaaagccttcagtcacaaggaaaaacttattaaacattataaaattcacagtagggagcagtcttacaaatgtaatgaatgtggtaaagctttcattaaaatgtcaaatctcattagacatcaaagaattcatactggagagaagccctatgcatgtaaggaatgtgagaagtccttcagccagaaatcaaatcttattgatcatgaaaaaattcatactggagagaaaccttatgaatgtaatgagtgtggaaaagcattcagccagaagcaaagcctcattgcacatcagaaagttcatactggggagaaaccttatgcatgtaatgaatgtggtaaagccttccctcgaattgcatcccttgctcttcatatgagaagtcatacaggagaaaaaccttataaatgtgataaatgtggtaaagccttctctcagttttccatgcttattatacatgttagaattcatacaggtgaaaaaccctatgaatgtaatgagtgtggaaaagccttctctcaaagctcagcccttactgtacatatgagaagtcacactggtgagaaaccctatgaatgtaaggaatgcagaaaagccttcagccacaagaaaaacttcattacacaccagaaaattcatactagagagaaaccttatgagtgtaatgaatgtgggaaagcttttatacagatgtcaaatcttgttagacaccagagaattcatactggggaaaaaccctatatatgtaaggaatgtgggaaagcctttagccagaaatcaaatctcattgctcatgaaaaaattcattctggagagaaaccctatgaatgcaatgaatgtggtaaagccttcagccaaaagcaaaacttcattacacatcaaaaagttcatactggagagaaaccttatgattgtaatgaatgtggtaaagccttctctcaaattgcatcccttacccttcatttgagaagtcatacaggggaaaagccttatgaatgtgataaatgtggtaaagccttctctcagtgctcactgcttaatttacatatgagaagtcacacaggtgagaagccctatgtatgtaatgaatgtgggaaagccttctctcaaagaacttcccttattgtgcacatgagaggccatacaggtgaaaaaccctatgaatgtaataaatgtggaaaagccttctcccaaagctcatcccttactatacatatacgaggacatacaggtgagaaacccttcgactgtagtaaatgtggaaaagccttctctcaaatctcatctcttacccttcatatgagaaaacatacaggtgagaagccctatcactgtattgagtgtggcaaggctttcagccaaaagtcgcaccttgttagacaccagagaattcatactcattagaaaccctatgaatattgtgaatatggcaaggccatctgaaggaattaacacctcattgcacattacatgatcacttccagagtagaaaactatgaatgtgggatagccttctgaaaaagccacaaatttatgaaacattagagaattcttccaaggtgacaaattatataatgaaaaagctgttaccagaaactttcagcagacatcttattgataatatttaatcagcattctcattgaaatctgaaacaaggtatcttccatcagcataacaacacaacacttgagctcctagccaatgtattaagtaaggaaaacaagtatcaacgaagaactataaaaataacttttatacaagaaataattagaaaatgtgttgatagaaaacctaagaataaacacaacaatgagttaggtctttatcaagttataaaatatgttgaaaggcacaaaagaacacctgaaaaatgatattttgtctgaaaagacttgacattgtaaaaatataatttctctcccaaatcactaagtttaatatacttctgaagtttacatcagttttattttaaggaacttcacaaacttatccaaaaattttatgtggaaaagtaaagaaacacaaatagctgaaacaaacttgacaaagcaagtagagaagacacactctattattagatatatcatgtacttatttaaagctgctgtcatttaaacaatgtattaccaagtgaataaatcaagcagtagtaagatagtgagcattcatacaaaaatccaagaagatacaggaattctgtgtatgacagtgctattgaaatcactggggaatgaatggcttatttaataaatggaaggttcataggagaaaaattttagctttctactttatatcatatacaaaaataaaatccaactaaagaccagaatataaaaagcaaaattttaaaactatgatgaaagtagaatccgttactttagggtaacaagatttctttaaaaaacatgtaaacatggaatagtctgttgaattttggtgtattggcctcacaggcacccacaaatgtacacaaagagatatatatcactgtgttcctgaatcatggtttgtattgcccaaaattggatataacaaatttttatcaattgtggaatagatgaataagtgtgatcatttctgtgataaaatacagaatttagaaacaaaatctacctatagttatatggatagattacaatatataatattgagagaaaaaattaaaatgcacaaaggaacacagtataacatttgtataatttaataagatcttgcaaagaacagtactgtgtattggtcatggatccatatatgacttggttgccttttgggatgtgggaaaggtttggtgggagttgttatatttatctgtaatatttctttaataaaagagtgaaagcaaata

SEQ ID NO: 203007 - DNA, 1918 bp, Homo sapiens
  Payload ID: 20033
  Gene Name: zinc finger protein 569
  Uniprot ID: Q5MCW4
  ENST ID: ENST00000392150
  CDS Start-End: 293-1876
cttctgcaggccccatcccttcccagaaagaagaggaaatgactgagtcccaggagaaatatggggagttgatgagcatcagaaaaaccaggacagacttttgagacaagttgaagttaaattccagaaaacactgactgaagaaaaaggcaatgaatgtcaaaagaaatttgcaaatgtatttcctctgaactctgattttttcccttccagacacaatctctatgagtatgacttatttggaaagtgtttagaacataattttgactgtcataataatgtgaaatgccttatgagaaaggagcattgtgaatataatgaacctgtgaaatcatatggtaatagctcatcccattttgtcattaccccctttaagtgtaatcattgtggaaaaggcttcaatcagactttggacctcatcagacatctgagaattcatactggagagaagccctatgaatgtagtaactgtagaaaagccttcagtcacaaggaaaaacttattaaacattataaaattcacagtagggagcagtcttacaaatgtaatgaatgtggtaaagctttcattaaaatgtcaaatctcattagacatcaaagaattcatactggagagaagccctatgcatgtaaggaatgtgagaagtccttcagccagaaatcaaatcttattgatcatgaaaaaattcatactggagagaaaccttatgaatgtaatgagtgtggaaaagcattcagccagaagcaaagcctcattgcacatcagaaagttcatactggggagaaaccttatgcatgtaatgaatgtggtaaagccttccctcgaattgcatcccttgctcttcatatgagaagtcatacaggagaaaaaccttataaatgtgataaatgtggtaaagccttctctcagttttccatgcttattatacatgttagaattcatacaggtgaaaaaccctatgaatgtaatgagtgtggaaaagccttctctcaaagctcagcccttactgtacatatgagaagtcacactggtgagaaaccctatgaatgtaaggaatgcagaaaagccttcagccacaagaaaaacttcattacacaccagaaaattcatactagagagaaaccttatgagtgtaatgaatgtgggaaagcttttatacagatgtcaaatcttgttagacaccagagaattcatactggggaaaaaccctatatatgtaaggaatgtgggaaagcctttagccagaaatcaaatctcattgctcatgaaaaaattcattctggagagaaaccctatgaatgcaatgaatgtggtaaagccttcagccaaaagcaaaacttcattacacatcaaaaagttcatactggagagaaaccttatgattgtaatgaatgtggtaaagccttctctcaaattgcatcccttacccttcatttgagaagtcatacaggggaaaagccttatgaatgtgataaatgtggtaaagccttctctcagtgctcactgcttaatttacatatgagaagtcacacaggtgagaagccctatgtatgtaatgaatgtgggaaagccttctctcaaagaacttcccttattgtgcacatgagaggccatacaggtgaaaaaccctatgaatgtaataaatgtggaaaagccttctcccaaagctcatcccttactatacatatacgaggacatacaggtgagaaacccttcgactgtagtaaatgtggaaaagccttctctcaaatctcatctcttacccttcatatgagaaaacatacaggtgagaagccctatcactgtattgagtgtggcaaggctttcagccaaaagtcgcaccttgttagacaccagagaattcatactcattagaaaccctatgaatattgtgaatatggcaaggccatctgaagg

SEQ ID NO: 203008 - DNA, 789 bp, Homo sapiens
  Payload ID: 20033
  Gene Name: zinc finger protein 569
  ENST ID: ENST00000591710
  CDS Start-End: 576-789
gggaaatgtagttcggcgcaggaagcagcggaacgattcgattcttctcagcaccaagttgcgctcccaatctctcagagctgggctcgcgggaggccgctcgtgcaaaacctaggctgagctcccctgcgcggagctgtgagccctggaacaccgtggtctgcttctcaggacgcgcaaacagtgaagccagtcccgcccggagttcttcatatattaaggattcattcattcatagactcatttattgaaggctgtctgtgtaacaggcacaatcctaggtgcttgggatatagcagtgaacaagagacaaaccccctactatcatggtacttacatttttgtgggctggataataaacaagggatgtaaacagctggaaagaactttgcttcaatcattacaacaaggaaactacaaacttctaccgtacaacaaggaaatggacaaactacaaaataatttttctaggacccttcagagaactgaggtcacagggcaaccaagtaatcttaaatctggggaaagaaagatgccagctgagagaaacaggactcaagctttacttacctgggatggactctgccagacaccatataagccactctacttctgcaggccccatcccttcccagaaagaagaggaaatgactgagtcccagggaacagtaacattcaaagatgtggctatcgacttcactcaggaggagtggaagagattggatcctgctcagagaaaactgtaccggaatgtgatgctagaaaactataacaacttaatcacagtag

SEQ ID NO: 203009 - DNA, 579 bp, Homo sapiens
  Payload ID: 20033
  Gene Name: zinc finger protein 569
  ENST ID: ENST00000592490
  CDS Start-End: 330-395
gacttgtggcgctctcagccaccgacagcgccggcctcagtgccgcctctgtcccagcccgcgccggctctgccactttggcagcgttaagtgtggaatcggggcctgtgtccgcgggcttggtgagttcttcatatattaaggattcattcattcatagactcatttattgaaggctgtctgtgtaacaggcacaatcctaggtgcttgggatatagcagtgaacaagagacaaaccccctactatcatggtacttacatttttgtgggctggataataaacaagctctacttctgcaggccccatcccttcccagaaagaagaggaaatgactgagtcccaggagaaatatggggagttgatgagcatcagaaaaaccaggacagacttttgagacaagttgaagttaaattccagaaaacactgactgaagaaaaaggcaatgaatgtcaaaagaaatttgcaaatgtatttcctctgaactctgattttttcccttccagacacaatctctatgagtatgacttatttggaaagtgtttagaacataattttgactgtcataataatgtgaaatg

SEQ ID NO: 203010 - DNA, 1716 bp, Homo sapiens
  Payload ID: 20033
  Gene Name: zinc finger protein 569
  ENST ID: ENST00000448051
  CDS Start-End: 936-1716
agaaaaggtcgcggcgtcgcagtgtctggcagcagcggtgcagctccgcgcagggtttgtaacacggcctcctccccaccaggtcctcccacactggcctctccccggccttccagagagcccgaaagtccggattccctgcagctccgagcctggcccggtcacagggacggggcccagcgtcacactacacgggctggtgtggaagtgcgcaggcacaagcgctctgcgcgcctcccttagcaaccagggcggggagttgagaatcgcaggttggccgcagggaaaaggacgcgcaaacagtgaagccagtcccgcccgggtgagccgcgggggcctctgggaagcgtcgcccctggtgtaacggaccgagacttgtggcgctctcagccaccgacagcgccggcctcagtgccgcctctgtcccagcccgcgccggctctgccactttggcagcgttaagtgtggaatcggggcctgtgtccgcgggcttggtgtatgaacctgcgtgcaaacgtgcatgacagtgggatcttgaatgaatgaaaaactgtggatacaagagttcttcatatattaaggattcattcattcatagactcatttattgaaggctgtctgtgtaacaggcacaatcctaggtgcttgggatatagcagtgaacaagagacaaaccccctactatcatggtacttacatttttgtgggctggataataaacaagggatgtaaacagctggaaagaactttgcttcaatcattacaacaaggaaactacaaacttctaccgtacaacaaggaaatggacaaactacaaaataatttttctaggacccttcagagaactgaggtcacagggcaaccaagtaatcttaaatctggggaaagaaagatgccagctgagagaaacaggactcaagctttacttacctgggatggactctgccagacaccatataagccactctacttctgcaggccccatcccttcccagaaagaagaggaaatgactgagtcccagggaacagtaacattcaaagatgtggctatcgacttcactcaggaggagtggaagagattggatcctgctcagagaaaactgtaccggaatgtgatgctagaaaactataacaacttaatcacagtaggctatccgttcaccaaacctgatgtgattttcaaattggagcaagaagaagaaccatgggtgatggaggaagaagtattaaggagacactggcaaggagaaatatggggagttgatgagcatcagaaaaaccaggacagacttttgagacaagttgaagttaaattccagaaaacactgactgaagaaaaaggcaatgaatgtcaaaagaaatttgcaaatgtatttcctctgaactctgattttttcccttccagacacaatctctatgagtatgacttatttggaaagtgtttagaacataattttgactgtcataataatgtgaaatgccttatgagaaaggagcattgtgaatataatgaacctgtgaaatcatatggtaatagctcatcccattttgtcattaccccctttaagtgtaatcattgtggaaaaggcttcaatcagactttggacctcatcagacatctgagaattcatactggagagaagccctatgaatgtagtaactgtagaaaagccttcagtcacaaggaaaaacttattaaacattataaaattcaca

SEQ ID NO: 203011 - DNA, 762 bp, Homo sapiens
  Payload ID: 20033
  Gene Name: zinc finger protein 569
  ENST ID: ENST00000589833
  CDS Start-End: 214-528
agggatgtaaacagctggaaagaactttgcttcaatcattacaacaaggaaactacaaacttctaccgtacaacaaggaaatggacaaactacaaaataatttttctaggacccttcagagaactgaggtcacagggcaaccaagtaatcttaaatctggggaaagaaagatgccagctgagagaaacaggactcaagctttacttacctgggatggactctgccagacaccatataagccactctacttctgcaggccccatcccttcccagaaagaagaggaaatgactgagtcccagggaacagtaacattcaaagatgtggctatcgacttcactcaggaggagtggaagagattggatcctgctcagagaaaactgtaccggaatgtgatgctagaaaactataacaacttaatcacagtaggctatccgttcaccaaacctgatgtgattttcaaattggagcaagaagaagaaccatgggtgatggaggaagaagtattaaggagacactggcaaggttagtggaagggaaccagacaggtgaggagaggtcagggcctattaatgattaatcagtgaatggttgatccctctaaaatattcttcaaagatattttcagaggttggcacagtggttcatacctatagtcccagcactttgggaagccaaggtggaaggattgcttgagtccaggagtttgggaccagcctgggcaacatagtgagacctcatctcttaaaaaaaaaagagaaaag

SEQ ID NO: 203012 - DNA, 2003 bp, Homo sapiens
  Payload ID: 20034
  Gene Name: zinc finger protein 57
  Uniprot ID: Q68EA5
  ENST ID: ENST00000306908
  CDS Start-End: 149-1816
tccgaggccccgagggcgggacgtttcgtcctccctgccgcgcgtgccctgcctaccacgagcggcccgggagtacctgtacctttcagctgcgccggccgcgaggccacggagagctcgccttggagagcccaggagcaggggagacatggactcagtggtctttgaggatgtggctgtggacttcaccctggaggagtgggctttgctggattctgctcagagggacctctacagagatgtgatgctggagaccttccggaacctggcctcagtagatgatgggactcaatttaaagccaatgggtcagtttctctgcaggatatgtacgggcaagaaaaatctaaggaacagacaataccaaacttcacaggaaataattcctgtgcctacactttagaaaaaaattgtgaaggctatggcactgaagaccaccacaaaaatctgagaaatcatatggtggacagattctgtacacataatgaaggtaatcaatatggagaagccatccatcaaatgccagatcttaccctgcacaagaaagtttctgctggagaaaaaccatatgaatgcaccaagtgcaggacagtcttcacgcatctttcttctcttaaaaggcacgtcaagtctcactgtggacgaaaagcacctccaggtgaggaatgtaagcaggcctgcatttgtccctcacacctacacagtcacggaagaactgacactgaggagaagccgtataagtgtcaagcatgtgggcaaactttccaacatcctcgttacctctcccaccacgtaaagactcacacagcagagaaaacctacaaatgcgagcagtgtcggatggcgtttaatgggttcgcaagcttcactagacatgtgagaactcacacaaaagacaggccatataaatgtcaggaatgtgggagagccttcatttatccctcgacatttcaaagacacatgacaacacacactggagagaagccctataaatgtcagcactgtgggaaagccttcacttacccccaggcttttcaaagacatgagaagacgcacacgggagagaagccctatgaatgcaagcagtgtgggaaaacattcagttggtctgaaaccttgcgagtccacatgaggatccacactggggacaaactctataaatgtgaacactgtgggaaggcttttacctcttccagatcattccaaggtcatttgaggacgcacactggagagaaaccttatgagtgtaaacaatgtgggaaagccttcacttggtcctcaacgtttagagaacatgtgagaattcacacgcaagagcagctctataaatgtgaacaatgtgggaaggcttttacctcttccagatcattccgaggtcatttgaggacgcacactggagagaagccttatgagtgtaaacaatgtggaaaaaccttcacttggtcctcaacgtttagagaacatgtgagaattcacacgcaagagcagctccataaatgtgaacactgtgggaaggcctttacctcttccagagcattccaaggtcatttgaggatgcacactggagagaagccttatgagtgtaaacaatgtggaaaaaccttcacttggtcctcaaccttacataatcatgtgaggatgcacactggagagaaacctcacaaatgtaaacaatgtgggatgtccttcaagtggcactcctccttccggaaccatctgaggatgcacacaggacagaaatcccacgaatgtcagtcatactcaaaagccttcagttgccaagtcattctttctaaaaccagtgagagcacacactaaagagaaattctataactttaatggggtaacctcacattaattcatgtataatgctccagaaaattcacaccaggagagaaatcttacaagtatgatattgtctttgtcaatacctcatttgtaaaacagacccattagtcgtgaatttccagctctttcaaaaataaatgtttatgtgagaaaataa

SEQ ID NO: 203013 - DNA, 1774 bp, Homo sapiens
  Payload ID: 20034
  Gene Name: zinc finger protein 57
  ENST ID: ENST00000523428
  CDS Start-End: 146-1717
gtcccacaagtaggctgatttctgatcgcacagatgggtcagagtaaaacctgactcagtggtctttgaggatgtggctgtggacttcaccctggaggagtgggctttgctggattctgctcagagggacctctacagagatgtgatgctggagaccttccggaacctggcctcagtagatgatgggactcaatttaaagccaatgggtcagtttctctgcaggatatgtacgggcaagaaaaatctaaggaacagacaataccaaacttcacaggaaataattcctgtgcctacactttagaaaaaaattgtgaaggctatggcactgaagaccaccacaaaaatctgagaaatcatatggtggacagattctgtacacataatgaaggtaatcaatatggagaagccatccatcaaatgccagatcttaccctgcacaagaaagtttctgctggagaaaaaccatatgaatgcaccaagtgcaggacagtcttcacgcatctttcttctcttaaaaggcacgtcaagtctcactgtggacgaaaagcacctccaggtgaggaatgtaagcaggcctgcatttgtccctcacacctacacagtcacggaagaactgacactgaggagaagccgtataagtgtcaagcatgtgggcaaactttccaacatcctcgttacctctcccaccacgtaaagactcacacagcagagaaaacctacaaatgcgagcagtgtcggatggcgtttaatgggttcgcaagcttcactagacatgtgagaactcacacaaaagacaggccatataaatgtcaggaatgtgggagagccttcatttatccctcgacatttcaaagacacatgacaacacacactggagagaagccctataaatgtcagcactgtgggaaagccttcacttacccccaggcttttcaaagacatgagaagacgcacacgggagagaagccctatgaatgcaagcagtgtgggaaaacattcagttggtctgaaaccttgcgagtccacatgaggatccacactggggacaaactctataaatgtgaacactgtgggaaggcttttacctcttccagatcattccaaggtcatttgaggacgcacactggagagaaaccttatgagtgtaaacaatgtgggaaagccttcacttggtcctcaacgtttagagaacatgtgagaattcacacgcaagagcagctctataaatgtgaacaatgtgggaaggcttttacctcttccagatcattccgaggtcatttgaggacgcacactggagagaagccttatgagtgtaaacaatgtggaaaaaccttcacttggtcctcaacgtttagagaacatgtgagaattcacacgcaagagcagctccataaatgtgaacactgtgggaaggcctttacctcttccagagcattccaaggtcatttgaggatgcacactggagagaagccttatgagtgtaaacaatgtggaaaaaccttcacttggtcctcaaccttacataatcatgtgaggatgcacactggagagaaacctcacaaatgtaaacaatgtgggatgtccttcaagtggcactcctccttccggaaccatctgaggatgcacacaggacagaaatcccacgaatgtcagtcatactcaaaagccttcagttgccaagtcattctttctaaaaccagtgagagcacacactaaagagaaattctataactttaatggggtaacctcacattaattcatgtataatgctcc

SEQ ID NO: 203014 - DNA, 713 bp, Homo sapiens
  Payload ID: 20034
  Gene Name: zinc finger protein 57
  ENST ID: ENST00000522294
  CDS Start-End: 272-713
gtcccacaagtaggctgatttctgatcgcacagatgggtcagagtaaaaccttctattcttgagcctgtgccccgcgacactgaacttcacaagtgcttctcagttcttccttctcctctcacttggcgggacaagatgaatagaggaagatgatgggggatacatctctttccacaggactcagtggtctttgaggatgtggctgtggacttcaccctggaggagtgggctttgctggattctgctcagagggacctctacagagatgtgatgctggagaccttccggaacctggcctcagtagatgatgggactcaatttaaagccaatgggtcagtttctctgcaggatatgtacgggcaagaaaaatctaaggaacagacaataccaaacttcacaggaaataattcctgtgcctacactttagaaaaaaattgtgaaggctatggcactgaagaccaccacaaaaatctgagaaatcatatggtggacagattctgtacacataatgaaggtaatcaatatggagaagccatccatcaaatgccagatcttaccctgcacaagaaagtttctgctggagaaaaaccatatgaatgcaccaagtgcaggacagtcttcacgcatctttcttctcttaaaaggcacgtcaagtctcactgtggacgaaaagcacctccaggtgaggaatgtaagcaggcctgcatttgtc

SEQ ID NO: 203015 - DNA, 623 bp, Homo sapiens
  Payload ID: 20034
  Gene Name: zinc finger protein 57
  ENST ID: ENST00000590305
  CDS Start-End: 171-623
aatttatgaattgagtccagttccccagtactttcagtgtctccaatcctcctgcacacctgtgtggtttgtcttaggactcagtggtctttgaggatgtggctgtggacttcaccctggaggagtgggctttgctggattctgctcagagggacctctacagagatgtgatgctggagaccttccggaacctggcctcagtagatgatgggactcaatttaaagccaatgggtcagtttctctgcaggatatgtacgggcaagaaaaatctaaggaacagacaataccaaacttcacaggaaataattcctgtgcctacactttagaaaaaaattgtgaaggctatggcactgaagaccaccacaaaaatctgagaaatcatatggtggacagattctgtacacataatgaaggtaatcaatatggagaagccatccatcaaatgccagatcttaccctgcacaagaaagtttctgctggagaaaaaccatatgaatgcaccaagtgcaggacagtcttcacgcatctttcttctcttaaaaggcacgtcaagtctcactgtggacgaaaagcacctccaggtgaggaatgtaagcaggcctgcatttgtccctcacaccta

SEQ ID NO: 203016 - DNA, 2002 bp, Homo sapiens
  Payload ID: 20034
  Gene Name: zinc finger protein 57
  ENST ID: ENST00000614108
  CDS Start-End: 149-1822
tccgaggccccgagggcgggacgtttcgtcctccctgccgcgcgtgccctgcctaccacgagcggcccgggagtacctgtacctttcagctgcgccggccgcgaggccacggagagctcgccttggagagcccaggagcaggggagacatggactcagtggtctttgaggatgtggctgtggacttcaccctggaggagtgggctttgctggattctgctcagagggacctctacagagatgtgatgctggagaccttccggaacctggcctcagtaggatgtgaaatgtgggaaaggaccaatgggtcagtttctctgcaggatatgtacgggcaagaaaaatctaaggaacagacaataccaaacttcacaggaaataattcctgtgcctacactttagaaaaaaagcggatcacgaggtcaggagatcaatcccagctacctgtgaggcggagaaatcatatggtggacagattctgtacacataatgaaggtaatcaatatggagaagccatccatcaaatgccagatcttaccctgcacaagaaagtttctgctggagaaaaaccatatgaatgcaccaagtgcaggacagtcttcacgcatctttcttctcttaaaaggcacgtcaagtctcactgtggacgaaaagcacctccaggtgaggaatgtaagcaggcctgcatttgtccctcacacctacacagtcacggaagaactgacactgaggagaagccgtataagtgtcaagcatgtgggcaaactttccaacatcctcgttacctctcccaccacgtaaagactcacacagcagagaaaacctacaaatgcgagcagtgtcggatggcgtttaatgggttcgcaagcttcactagacatgtgagaactcacacaaaagacaggccatataaatgtcaggaatgtgggagagccttcatttatccctcgacatttcaaagacacatgacaacacacactggagagaagccctataaatgtcagcactgtgggaaagccttcacttacccccaggcttttcaaagacatgagaagacgcacacgggagagaagccctatgaatgcaagcagtgtgggaaaacattcagttggtctgaaaccttgcgagtccacatgaggatccacactggggacaaactctataaatgtgaacactgtgggaaggcttttacctcttccagatcattccaaggtcatttgaggacgcacactggagagaaaccttatgagtgtaaacaatgtgggaaagccttcacttggtcctcaacgtttagagaacatgtgagaattcacacgcaagagcagctctataaatgtgaacaatgtgggaaggcttttacctcttccagatcattccgaggtcatttgaggacgcacactggagagaagccttatgagtgtaaacaatgtggaaaaaccttcacttggtcctcaacgtttagagaacatgtgagaattcacacgcaagagcagctccataaatgtgaacactgtgggaaggcctttacctcttccagagcattccaaggtcatttgaggatgcacactggagagaagccttatgagtgtaaacaatgtggaaaaaccttcacttggtcctcaaccttacataatcatgtgaggatgcacactggagagaaacctcacaaatgtaaacaatgtgggatgtccttcaagtggcactcctccttccggaaccatctgaggatgcacacaggacagaaatcccacgaatgtcagtcatactcaaaagccttcagttgccaagtcattctttctaaaaccagtgagagcacacactaaagagaaattctataactttaatggggtaacctcacattaattcatgtataatgctccagaaaattcacaccaggagagaaatcttacaagtatgatattgtctttgtcaatacctcatttgtaaaacagacccattagtcgtgaatttccagctctttcaaaaataaatgtttatgtgag

SEQ ID NO: 203017 - DNA, 5559 bp, Homo sapiens
  Payload ID: 20035
  Gene Name: zinc finger protein 570
  Uniprot ID: Q96NI8
  ENST ID: ENST00000330173
  CDS Start-End: 530-2140
gtagtgtgacgctgggccccgtccctgtgaccgggccaggctcggagctgcagggaatccggactttcgggctctctggaaggccggggagaggccagtgtgggaggacctggtggggaggaggccgtgttacaaaccctgcgcggagctgcaccgctgctgccagacactgcgacgccgcgaccttttctactccggactacgtttcccagcggaccccgcgggagttgggccggcggcccctttgtgtcctccgggggcggaggcagctgaggcgcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggagtcatctgaggccactgctatttcccaagagaagagccaggaggaagaaagaatggctgttgggcttcttaaagccatgtaccaggagttggtgaccttcagagatgtggctgtagacttctcccaagaggaatgggattgtctggattcttctcaaagacatctgtacagtaatgtgatgctagagaactacaggatcttggtatcactgggactttgcttttccaaaccaagtgtgatattattgttggaacaaggaaaagcaccctggatggtgaagagagagctgacaaaaggcttgtgctcaggctgggagcctatatgtgagactgaagaattaaccccaaagcaggatttttatgaagaacatcaatcccagaagataatagaaacacttacaagctataaccttgaatactccagtttgagagaagagtggaaatgtgagggctattttgaaaggcaaccaggtaatcagaaggcgtgtttcaaggaagagataatcactcatgaagaacccctttttgatgagagagaacaagaatataaatcttggggaagttttcatcagaacccactgctttgtacacaaaagataatccccaaagaggagaaagtacataaacatgacacacaaaagagaagctttaaaaaaaatttaatggctattaagcccaagagtgtctgtgcagagaagaaacttttgaaatgtaatgactgtgaaaaagtcttcagccagagttcatcccttactcttcatcaaagaattcatactggagagaaaccctataaatgtatagagtgtggaaaagccttcagccagagatcaaatcttgttcaacatcagaggattcatactggagaaaaaccctatgaatgtaaggaatgtaggaaagccttcagtcagaatgcacacctagttcaacatctgcgagttcatactggagaaaaaccttacgaatgtaaggtatgtcgaaaagccttcagccagtttgcctaccttgctcaacatcagagagttcacacgggagagaaaccctatgaatgtatcgaatgtgggaaagcatttagcaacagatcatccattgctcaacaccagagagttcatacaggagagaaaccctatgaatgtaatgtctgtgggaaagcatttagccttcgtgcataccttactgtacatcagagaatacatactggagagagaccctatgaatgtaaggaatgtgggaaggcctttagccagaattcacaccttgctcaacatcagagaattcatactggagaaaaaccttataagtgtcaggaatgtaggaaagcattcagccagattgcctaccttgctcagcatcaaagagttcatactggagagaaaccctatgaatgtattgaatgtgggaaggcttttagcaatgactcgtcccttactcaacatcagcgagttcatactggagagaaaccttatgaatgtactgtttgtggaaaggcttttagttactgtggatcccttgcccaacatcagagaattcatactggagagagaccctatgaatgtaaggaatgcaaaaaaaccttcaggcagcatgcacaccttgctcatcaccagagaattcacattggggagtcactgtcaccacccaacccagtcaatcaccaagtcctatagatcctgagtcctaaatgtttctagaatttatactgttttttatctttaatgttgtcaccttggtctgattcatctcactctgattactaatatagctttcaaacaggttttcctgtatttatttttgctacctttaaatccatttcccacaatgcactcaaacggatcttttttttctttttttttctttttgagacaatgtcttgctgtgttgcccaggctggagtacagtgggacgatctcagctcactgcaacctctgactcccagcctctgcctccagggttcaagcaattctcatgcatcagcctcccgagtagctgggactatagacatgcaccaccatgcctggctaatttttgtattttttagtagagatggggttttgccatgttggccaggctggtcttgaactcctgatctcaagtgatctgtctgtctcggcctcccaaagtgctgggattacaggcatgagccaccacgcccagcctcaaagtgttctttttaaagaataagaaaacacacatgggctgggtgtgatggctcatgcctgtaatcgcagcgctttgggaggccaaggcaggcagatcacccaaggtcaggagtttgagaccagccagactaacatggcgaaactccatctctactaaaaatacaaaattagccgggcgtggtggtgcacacttgtaatcccagctactctggaggctgaggcaggagcattgcttgaacccaggaggcagaggttgcagtgagccgagatggcgccattgcattccaacctgggcaacaaggctgcaactccgtctcaaaataaaaagaaaagaagagaaaagaaaacacatgttactatctccagttaaaactttttttttttttttgcttgttattgttcttagactaatattcacagcctttaaaattgtctgcaaggcttttgttatttggttcttacacaccattcagccttattttattccagtcttcttctttgggcactaggcacttcccaggactaagagcttagattctggaaaatcatagctccaacactactatggcattgcgtgactttgagcaatttgcttatctaaacctcagggttttctttaaatcttaaaataggaataatataggatactgtactgtagaaatgtaagtattaagtgaaatagtgtctgttgtagattgatgcatattaaatgagaaatttgcatgtaaaatacttcatatagtctgtcaaatatagcagatattcaataaatgataatagctaacatgtattgagtgcccactacacatcaggcactgtcttacatactctacatatattaactcatctactcctcacaaaacaagattccttattggacaaagtggagcattcctgcaaaacaccagttcagaatttggaaaatctaaaaatgttagaacataaatggcagtctttgtactgtagcttagtagttgttatgaagtcaggtagtggaactataacactgacagccagttttaggaagtttctacagataatgaattggataagccaattaagaaaaatagaattcactgggaagaatgcagaacctacatttaaatcaaggaaggaatagaaatggtcacaattaaccaaaaaaaatcaataaacatagaaattcatgtgatccccttaaataggcaccacaccctggccaggtgcagtagctcattcctgtaatcccagcactttgggaggccgaggtgggtggattatgaggtcaggagttcgagaccagcctgcctaacatggtgaaaccccatctctactaaaaatataacagttagccaggtgtggtggcgcacgcctgtaatcccagctactcaggaggctgaggcaagagaattgcttgaacccaggagacagaggttgcagtgagctgagatcgtgctactgcaccccagcctgggcaatacagcaagactccatctcaaaaaaaaaaaaaaaaaaaaaaaaaaagcactacccccagctaattgtatggttaaattcgggtaatttagaaggcatgtaaagtgttccatactatagaaaaatgtaaagttttaaaattatttatccagtggttgcaaaattgaaatcaaaaggggattaagggaagaaaacagatagatacacaaataatataggcattcattctgttaatattgagtaattactgtttgtcagacactgttttaggtatgaggaaatgacagtgagcaatacaaaggccacattctcatggagtaaaattccagaggtggagacatgtaattaatacttaaatataaaacagtagattttctaaacgcagaaaacggaagagtaacaagaaactaaatcaaggagcattatatagcctagactgcagagactcaatataataaagttggcgattcttcctaattatcaaatttactgcaattccagccaaaatgtttcagtggttttttttgtttgttgtttttgtttttgttttgccctttagcttcacaggtttgttctgaaatttatgaggtataaattcttaagagcagcaagaaaaatttcgaatctatttgtagaaactgcatatgatgatggttcataccagtagagagaaagattggatttgggggtattactagtagtaaggggattcactagtagtaagggaaatgcaaaataaaatcacattgaactagttcaaaatcatcacattggcaaaagcattagagtgccaattactggaaagatgtggagcaataggaacactcatacggtgctataggaagtagttgtgtttagcataatttggcaatgtctagtaaagttgaagatgtgaataatctttgacccagcaattccatgtttaaacctctacatagtctctcctcgtgtttcaaggagatacatatgatggtccattgcagaactgtgagaatgagaagttgaaagcaatctaaccattaggttaaatacaagatagaatgcaaactaaaatgaataactagagatatttctgtcaacatgggtaaacctcaaaaatagtattaatgaaattgaactacagactattttatataatacagtataacgtacaatttcaaaacatgcaaattagtgttatgtatttttgtcatggctaaatactatataaaaaggatctaaaagaattaataaaataatcatcagattcagaacagtggtgacctgcagggagaaagacaactgagattggggaaaggatgcaaatgaaaatacctttaattattcatttcttttaaaaataagcaaatactgtatagccaattcttaaaatttgataaagctggctgtgagtatatgagtcagttcttactctctgtatctttctgtataaactatttcataatgcaaaaaaataaagaatatttaaatga

SEQ ID NO: 203018 - DNA, 587 bp, Homo sapiens
  Payload ID: 20035
  Gene Name: zinc finger protein 570
  ENST ID: ENST00000590664
  CDS Start-End: 191-451
gcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggagtcatctgaggccactgctatttcccaagagaagagccaggaggaagaaagaatggctgttgggcttcttaaagccatgtaccaggagttggtgaccttcagagatgtggctgtagacttctcccaagaggaatgggattgtctggattcttctcaaagacatctgtacagtaatgtgatgctagagaactacaggatcttggtatcactgggactttgcttttccaaaccaagtgtgatattattgttggaacaaggaaaagcaccctggatggtgaagagagagctgacaaaaggcttgtgctcaggttagtgaagaggaaattggcaaaaatctttgcacgtgacagctcagcttgactcaaaggctgggagcctatatgtgagactgaagaattaaccccaaagcaggatttttatgaagaacatcaatcccagaagataataga

SEQ ID NO: 203019 - DNA, 1964 bp, Homo sapiens
  Payload ID: 20035
  Gene Name: zinc finger protein 570
  ENST ID: ENST00000588644
  CDS Start-End: 296-430
gcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggaggagttggtgaccttcagagatgtggctgtagacttctcccaagaggaatgggattgtctggattcttctcaaagacatctgtacagtaatgtgatgctagagaactacaggatcttggtatcactgggactttgcttttccaaaccaagtgtgatattattgttggaacaaggaaaagcaccctggatggtgaagagagagctgacaaaaggcttgtgctcaggttagtgaagaggaaattggcaaaaatctttgcacgtgacagctcagcttgactcaaaggctgggagcctatatgtgagactgaagaattaaccccaaagcaggatttttatgaagaacatcaatcccagaagataatagaaacacttacaagctataaccttgaatactccagtttgagagaagagtggaaatgtgagggctattttgaaaggcaaccaggtaatcagaaggcgtgtttcaaggaagagataatcactcatgaagaacccctttttgatgagagagaacaagaatataaatcttggggaagttttcatcagaacccactgctttgtacacaaaagataatccccaaagaggagaaagtacataaacatgacacacaaaagagaagctttaaaaaaaatttaatggctattaagcccaagagtgtctgtgcagagaagaaacttttgaaatgtaatgactgtgaaaaagtcttcagccagagttcatcccttactcttcatcaaagaattcatactggagagaaaccctataaatgtatagagtgtggaaaagccttcagccagagatcaaatcttgttcaacatcagaggattcatactggagaaaaaccctatgaatgtaaggaatgtaggaaagccttcagtcagaatgcacacctagttcaacatctgcgagttcatactggagaaaaaccttacgaatgtaaggtatgtcgaaaagccttcagccagtttgcctaccttgctcaacatcagagagttcacacgggagagaaaccctatgaatgtatcgaatgtgggaaagcatttagcaacagatcatccattgctcaacaccagagagttcatacaggagagaaaccctatgaatgtaatgtctgtgggaaagcatttagccttcgtgcataccttactgtacatcagagaatacatactggagagagaccctatgaatgtaaggaatgtgggaaggcctttagccagaattcacaccttgctcaacatcagagaattcatactggagaaaaaccttataagtgtcaggaatgtaggaaagcattcagccagattgcctaccttgctcagcatcaaagagttcatactggagagaaaccctatgaatgtattgaatgtgggaaggcttttagcaatgactcgtcccttactcaacatcagcgagttcatactggagagaaaccttatgaatgtactgtttgtggaaaggcttttagttactgtggatcccttgcccaacatcagagaattcatactggagagagaccctatgaatgtaaggaatgcaaaaaaaccttcaggcagcatgcacaccttgctcatcaccagagaattcacattggggagtcactgtcaccacccaacccagtcaatcaccaagtcctatagatcctgagtcctaaatgtttctagaatttatactgttttttatctttaatgttgtcaccttggtctgattcatctcactctgattactaatatagctttcaaacaggttttcctgtatttatttt

SEQ ID NO: 203020 - DNA, 1985 bp, Homo sapiens
  Payload ID: 20035
  Gene Name: zinc finger protein 570
  ENST ID: ENST00000586475
  CDS Start-End: 120-1898
gagagaccctgtccagtgacatctgaggtcgtgcgaatatgcgaccttttgtgtgaccatggtcgcgttttatattctcgtggctgtttgattctgaccttgcagttttgtcagagacaatgtgcatgtatttgttctttctggacttctcgattgtcgggagtgggctgaggagtggcgtgtgggtctccggaagctcgtcgcaggccatctgtgtgactccggtgcgagtggagtcatctgaggccactgctatttcccaagagaagagccaggaggaagaaagaatggctgttgggcttcttaaagccatgtaccaggagttggtgaccttcagagatgtggctgtagacttctcccaagaggaatgggattgtctggattcttctcaaagacatctgtacagtaatgtgatgctagagaactacaggatcttggtatcactgggactttgcttttccaaaccaagtgtgatattattgttggaacaaggaaaagcaccctggatggtgaagagagagctgacaaaaggcttgtgctcaggctgggagcctatatgtgagactgaagaattaaccccaaagcaggatttttatgaagaacatcaatcccagaagataatagaaacacttacaagctataaccttgaatactccagtttgagagaagagtggaaatgtgagggctattttgaaaggcaaccaggtaatcagaaggcgtgtttcaaggaagagataatcactcatgaagaacccctttttgatgagagagaacaagaatataaatcttggggaagttttcatcagaacccactgctttgtacacaaaagataatccccaaagaggagaaagtacataaacatgacacacaaaagagaagctttaaaaaaaatttaatggctattaagcccaagagtgtctgtgcagagaagaaacttttgaaatgtaatgactgtgaaaaagtcttcagccagagttcatcccttactcttcatcaaagaattcatactggagagaaaccctataaatgtatagagtgtggaaaagccttcagccagagatcaaatcttgttcaacatcagaggattcatactggagaaaaaccctatgaatgtaaggaatgtaggaaagccttcagtcagaatgcacacctagttcaacatctgcgagttcatactggagaaaaaccttacgaatgtaaggtatgtcgaaaagccttcagccagtttgcctaccttgctcaacatcagagagttcacacgggagagaaaccctatgaatgtatcgaatgtgggaaagcatttagcaacagatcatccattgctcaacaccagagagttcatacaggagagaaaccctatgaatgtaatgtctgtgggaaagcatttagccttcgtgcataccttactgtacatcagagaatacatactggagagagaccctatgaatgtaaggaatgtgggaaggcctttagccagaattcacaccttgctcaacatcagagaattcatactggagaaaaaccttataagtgtcaggaatgtaggaaagcattcagccagattgcctaccttgctcagcatcaaagagttcatactggagagaaaccctatgaatgtattgaatgtgggaaggcttttagcaatgactcgtcccttactcaacatcagcgagttcatactggagagaaaccttatgaatgtactgtttgtggaaaggcttttagttactgtggatcccttgcccaacatcagagaattcatactggagagagaccctatgaatgtaaggaatgcaaaaaaaccttcaggcagcatgcacaccttgctcatcaccagagaattcacattggggagtcactgtcaccacccaacccagtcaatcaccaagtcctatagatcctgagtcctaaatgtttctagaatttatactgttttttatctttaatgttgtcaccttggtctgattcatctcactctgattac

SEQ ID NO: 203021 - DNA, 581 bp, Homo sapiens
  Payload ID: 20035
  Gene Name: zinc finger protein 570
  ENST ID: ENST00000589725
  CDS Start-End: 137-581
agtgcgaggctgtcaccccgtgtgcctgtccacgtcctgtgtgactgggtgcgaggaagtcaatggcaccgtggaatgtgaggcttcatctgaggccactgctatttcccaagagaagagccaggaggaagaaagaatggctgttgggcttcttaaagccatgtaccaggagttggtgaccttcagagatgtggctgtagacttctcccaagaggaatgggattgtctggattcttctcaaagacatctgtacagtaatgtgatgctagagaactacaggatcttggtatcactgggactttgcttttccaaaccaagtgtgatattattgttggaacaaggaaaagcaccctggatggtgaagagagagctgacaaaaggcttgtgctcaggctgggagcctatatgtgagactgaagaattaaccccaaagcaggatttttatgaagaacatcaatcccagaagataatagaaacacttacaagctataaccttgaatactccagtttgagagaagagtggaaatgtgagggctattttgaaaggcaaccaggtaatcagaaggcgtgtttcaaggaag

SEQ ID NO: 203022 - DNA, 577 bp, Homo sapiens
  Payload ID: 20035
  Gene Name: zinc finger protein 570
  ENST ID: ENST00000587363
  CDS Start-End: 307-441
gtctttttgggtctctacctgaggctagaatacagcggggtgaaggtggtgagagctccagggccagtgaaggccgggtcagctggagccttaaggtcctgacagcggctagaagagggaggagtgacgtagtgtgactgtatgtgtgaaacttcggccatggaatttggagtggggtttccagggcgagagaccctgtccagtgacatctgaggtcgtgcgaatatgcgaccttttgtgtgaccatggtcgcgttttatattctcgtggctgtttgattctgaccttgcagttttgtcagagacaatgtgcatgtatttgttctttctggacttctcgattgtgagtgtgacagtgttattggatttcatgacccgggatcgtgagcgaaaagtagtgtggccagaccgcctgacttctaaacagacttggccttactagctgtgtcatctcagactaggtcgggagtgggctgaggagtggcgtgtgggtctccggaagctcgtcgcaggccatctgtgtgactccggtgcgagtggagtcatctgaggccactgctatttcccaagagaagagc

SEQ ID NO: 203023 - DNA, 4113 bp, Homo sapiens
  Payload ID: 20036
  Gene Name: zinc finger protein 571
  Uniprot ID: Q7Z3V5
  ENST ID: ENST00000328550
  CDS Start-End: 120-1949
acacttacgctgttatgtcttgacgcacggagcttgtctgcgccggccagcactggcttctctggactttgcacacctccaggagaagaacccagaaaattgatcagttctaaaaaaccatgccccacttgttggtgactttcagggatgtggccattgacttctctcaggaggaatgggaatgcctggaccctgctcagagggacttgtacagggatgtgatgttggagaactacagcaacctgatctcattggacttggaatccagttgtgtgaccaaaaagttatctccagaaaaggaaatttatgaaatggaatcactccagtgggagaatatggggaaacgtatcaaccatcaccttcaatacaatggtcttggagacaatatggagtgcaaaggcaacttagagggtcaagaagcaagtcaggaagggctttacatgtgtgtcaaaattacctgtgaagaaaaggccactgaaagtcattcaacctcttctacttttcatcggataattcctaccaaggaaaaattgtacaaatgtaaggaatgcagacaaggtttcagctacctgtcatgccttattcaacatgaggaaaatcataatatagaaaaatgctctgaagttaagaaacacaggaatacctttagcaaaaagccaagctatattcaacatcagagaattcagactggtgagaaaccttatgagtgtatggaatgtggaaaggcctttggtcgtacttctgatctcattcaacatcagaaaattcatactaatgaaaaaccttatcagtgtaacgcatgtgggaaagcttttattcgtggttcacagctcactgaacatcagagagttcatacaggagagaaaccatatgaatgtaagaaatgtggaaaagcctttagttattgttcacaatatactcttcatcagagaattcatagtggtgaaaaaccctatgaatgtaaggattgtgggaaggcctttattcttggctctcaacttacttaccatcagagaattcatagtggtgagaaaccttatgagtgtaaggaatgtggaaaggcctttattcttggttcacaccttacataccatcagagagttcatactggtgaaaagccttacatatgtaaagaatgtgggaaagcctttttatgtgcctcccaactgaatgaacatcagagaattcatacaggagagaaaccctatgaatgtaaagaatgcgggaagaccttttttcgtggctcacaacttacttaccacctgagagttcattcaggtgagagaccttataaatgcaaagaatgtgggaaagcctttatttctaattctaatcttattcaacatcaaagaattcataccggagagaagccctacaaatgtaaggaatgtggaaaggcctttatttgtggcaaacaacttagtgaacatcagagaattcatacaggtgagaaaccctttgaatgtaaggaatgtggaaaggcctttattcgtgttgcatatcttactcaacatgagaaaattcatggtgagaaacattatgaatgtaaggaatgtgggaagacctttgtacgtgctacacaacttacatatcatcaaagaattcatacaggtgaaaagccctacaaatgtaaggaatgtgacaaggcctttatttatggctcacaacttagtgaacatcagagaattcacagaggtgaaaaaccttatgaatgtaaacagtgtgggaaggcttttattcgtggctcacaccttactgaacatctgagaactcatactggagagaaaccctatgaatgtaaggaatgtgggagggcctttagtcgtggctcagaacttactctgcatcaaaggatccatactggtgagaaaccctatacatgtgtccagtgtggtaaagactttagatgtccttcacaacttactcaacatacaaggcttcataattgagaaagccttgaatgtgattaaatttaagaaaatcttcatctatttcatatctataatgaatgtagaacatcttgcttctgctcagaatctgctcattcttagaaggcctacattaacatggatgcagaataatttcagaaaccccttaaataattccttaacatctctataaacgctagaatataatgctgaattatatcctttattaagcatcatctccatttcaccatatcctaactgaaatcctatatatttcttgtgtgttcttttctatttgtaaaatactgtaattgtattacaatgactaaattataattaaatacatataattccctttcgatagcatctgatatttgttgttaaaatgattgccattatcatcattacatactgttagagaactcaaatggtgggaatattttatgattacagtaaaaagatgcaaccattctcttatcatgtagcccctttagaacaacagatactttattttagacaaaacctttaaagtatagtaaaggtatgaaggacttctgagcatcagataatccacaccaggaagaaacttccaaaaattgctttagggctgttgttttttgttgttttgttttttaagaaagtgaaagattatttttctacaacaaattccaaaagcaaaagtttttggcccacattttctgattgttactttaagggaaaaagaatttcttaacaaaatgatggccaaggtagttccatatatatacatatattccacatgtgtgtatgtggaatatattccacatgtgtgtatgtggaatatattccacatgtgtatatattccacgtgtatgtattccacatgtatatattccacatatgtatacattccacgtgtgtatatagtccccatatgtatacattccacgtgtgtatatattccacatatgtatacattccatgtatgtatgcatatatgtattccatatatgtatatattccatataccatatatgtatatattccacatatgtattccatatatatattccatatgtatatgtgtgtgtgtataaaatatatatttgccttaaatggaaatataaacaaaatttaccaactacagtttttcctcatttgaatctaacccatttctgatatactgaatggtaaatttttagagacccagatctcggaggctacattccattttttggtctttttgtcttttttttctttttttttgagacagggtcttgctctccttgttcaggctggagtacagtggcacaatcacagctcactgcagccttgacctcctaggctcaagctatcctccaacctcagcctgccaagtagctgtcaccatagctgttcatcaccatgcctagctcatttaaaaaaaaatttttttagagatggggtctcactatgtttcctcatctggtcttaaacttctaggctcaagcatctacctgcctcagcctccagaagtgctgggattacaaatgtgagccaccacatctggccccattattttatttttggtttgtattatttttatttggccccattattttaaataggaaaaacagtatgttttcagtccattaaaaaatcctaaccaaatttaatttgaattcaacttaatttaagccacctaaatgacctctatcagggatttctgaataatgtaaaacactcaaaagccagttaacagttaattaccagatatgtttgtgcatgcagtgattttgaaaaatataatacatgaattatgctttccttctatgctttaaggaacagatactatagtgacaataaatgtaatacattagtacataatggacgcaaatgacagataaaaacagctttaaataatttgaacttgttaattagaatgttgttgaatgagggctgatggtcagaaattaatgatggtgagaagaggttaatggtgttcagtgagtgaaggtgagttagaataatatattggagcagcaatcaatcaatgcctacagttcttctatgattccaagcatctggtgcacagaactcaagacctcaaaattgagttactgtatacaaagctgttcatagaaaaacaaatgttaccaagaaatacttaccttttctatatgcagtgttatctcttgtcttctaatacattatcttttttggtttc

SEQ ID NO: 203024 - DNA, 2049 bp, Homo sapiens
  Payload ID: 20036
  Gene Name: zinc finger protein 571
  Uniprot ID: Q7Z3V5
  ENST ID: ENST00000358744
  CDS Start-End: 191-2020
gagcttgtctgcgccggccagcgcttggcccctcccgggccgcagtactcctcgtgtgacacggacatcattaagccagctgagaatcgtgcggttacagctgctgcagtttctttgcagacactggcttctctggactttgcacacctccaggagaagaacccagaaaattgatcagttctaaaaaaccatgccccacttgttggtgactttcagggatgtggccattgacttctctcaggaggaatgggaatgcctggaccctgctcagagggacttgtacagggatgtgatgttggagaactacagcaacctgatctcattggacttggaatccagttgtgtgaccaaaaagttatctccagaaaaggaaatttatgaaatggaatcactccagtgggagaatatggggaaacgtatcaaccatcaccttcaatacaatggtcttggagacaatatggagtgcaaaggcaacttagagggtcaagaagcaagtcaggaagggctttacatgtgtgtcaaaattacctgtgaagaaaaggccactgaaagtcattcaacctcttctacttttcatcggataattcctaccaaggaaaaattgtacaaatgtaaggaatgcagacaaggtttcagctacctgtcatgccttattcaacatgaggaaaatcataatatagaaaaatgctctgaagttaagaaacacaggaatacctttagcaaaaagccaagctatattcaacatcagagaattcagactggtgagaaaccttatgagtgtatggaatgtggaaaggcctttggtcgtacttctgatctcattcaacatcagaaaattcatactaatgaaaaaccttatcagtgtaacgcatgtgggaaagcttttattcgtggttcacagctcactgaacatcagagagttcatacaggagagaaaccatatgaatgtaagaaatgtggaaaagcctttagttattgttcacaatatactcttcatcagagaattcatagtggtgaaaaaccctatgaatgtaaggattgtgggaaggcctttattcttggctctcaacttacttaccatcagagaattcatagtggtgagaaaccttatgagtgtaaggaatgtggaaaggcctttattcttggttcacaccttacataccatcagagagttcatactggtgaaaagccttacatatgtaaagaatgtgggaaagcctttttatgtgcctcccaactgaatgaacatcagagaattcatacaggagagaaaccctatgaatgtaaagaatgcgggaagaccttttttcgtggctcacaacttacttaccacctgagagttcattcaggtgagagaccttataaatgcaaagaatgtgggaaagcctttatttctaattctaatcttattcaacatcaaagaattcataccggagagaagccctacaaatgtaaggaatgtggaaaggcctttatttgtggcaaacaacttagtgaacatcagagaattcatacaggtgagaaaccctttgaatgtaaggaatgtggaaaggcctttattcgtgttgcatatcttactcaacatgagaaaattcatggtgagaaacattatgaatgtaaggaatgtgggaagacctttgtacgtgctacacaacttacatatcatcaaagaattcatacaggtgaaaagccctacaaatgtaaggaatgtgacaaggcctttatttatggctcacaacttagtgaacatcagagaattcacagaggtgaaaaaccttatgaatgtaaacagtgtgggaaggcttttattcgtggctcacaccttactgaacatctgagaactcatactggagagaaaccctatgaatgtaaggaatgtgggagggcctttagtcgtggctcagaacttactctgcatcaaaggatccatactggtgagaaaccctatacatgtgtccagtgtggtaaagactttagatgtccttcacaacttactcaacatacaaggcttcataattgagaaagccttgaatgtgattaaatttaaga

SEQ ID NO: 203025 - DNA, 2265 bp, Homo sapiens
  Payload ID: 20036
  Gene Name: zinc finger protein 571
  Uniprot ID: Q7Z3V5
  ENST ID: ENST00000451802
  CDS Start-End: 102-1931
cttgacgcacggagcttgtctgcgccggccagcactggcttctctggactttgcacacctccaggagaagaacccagaaaattgatcagttctaaaaaaccatgccccacttgttggtgactttcagggatgtggccattgacttctctcaggaggaatgggaatgcctggaccctgctcagagggacttgtacagggatgtgatgttggagaactacagcaacctgatctcattggacttggaatccagttgtgtgaccaaaaagttatctccagaaaaggaaatttatgaaatggaatcactccagtgggagaatatggggaaacgtatcaaccatcaccttcaatacaatggtcttggagacaatatggagtgcaaaggcaacttagagggtcaagaagcaagtcaggaagggctttacatgtgtgtcaaaattacctgtgaagaaaaggccactgaaagtcattcaacctcttctacttttcatcggataattcctaccaaggaaaaattgtacaaatgtaaggaatgcagacaaggtttcagctacctgtcatgccttattcaacatgaggaaaatcataatatagaaaaatgctctgaagttaagaaacacaggaatacctttagcaaaaagccaagctatattcaacatcagagaattcagactggtgagaaaccttatgagtgtatggaatgtggaaaggcctttggtcgtacttctgatctcattcaacatcagaaaattcatactaatgaaaaaccttatcagtgtaacgcatgtgggaaagcttttattcgtggttcacagctcactgaacatcagagagttcatacaggagagaaaccatatgaatgtaagaaatgtggaaaagcctttagttattgttcacaatatactcttcatcagagaattcatagtggtgaaaaaccctatgaatgtaaggattgtgggaaggcctttattcttggctctcaacttacttaccatcagagaattcatagtggtgagaaaccttatgagtgtaaggaatgtggaaaggcctttattcttggttcacaccttacataccatcagagagttcatactggtgaaaagccttacatatgtaaagaatgtgggaaagcctttttatgtgcctcccaactgaatgaacatcagagaattcatacaggagagaaaccctatgaatgtaaagaatgcgggaagaccttttttcgtggctcacaacttacttaccacctgagagttcattcaggtgagagaccttataaatgcaaagaatgtgggaaagcctttatttctaattctaatcttattcaacatcaaagaattcataccggagagaagccctacaaatgtaaggaatgtggaaaggcctttatttgtggcaaacaacttagtgaacatcagagaattcatacaggtgagaaaccctttgaatgtaaggaatgtggaaaggcctttattcgtgttgcatatcttactcaacatgagaaaattcatggtgagaaacattatgaatgtaaggaatgtgggaagacctttgtacgtgctacacaacttacatatcatcaaagaattcatacaggtgaaaagccctacaaatgtaaggaatgtgacaaggcctttatttatggctcacaacttagtgaacatcagagaattcacagaggtgaaaaaccttatgaatgtaaacagtgtgggaaggcttttattcgtggctcacaccttactgaacatctgagaactcatactggagagaaaccctatgaatgtaaggaatgtgggagggcctttagtcgtggctcagaacttactctgcatcaaaggatccatactggtgagaaaccctatacatgtgtccagtgtggtaaagactttagatgtccttcacaacttactcaacatacaaggcttcataattgagaaagccttgaatgtgattaaatttaagaaaatcttcatctatttcatatctataatgaatgtagaacatcttgcttctgctcagaatctgctcattcttagaaggcctacattaacatggatgcagaataatttcagaaaccccttaaataattccttaacatctctataaacgctagaatataatgctgaattatatcctttattaagcatcatctccatttcaccatatcctaactgaaatcctatatatttcttgtgtgttcttttctatttgtaaaatactgtaattgtattacaatgactaaattataattaaatacatataattccc

SEQ ID NO: 203026 - DNA, 293 bp, Homo sapiens
  Payload ID: 20036
  Gene Name: zinc finger protein 571
  ENST ID: ENST00000590390
  CDS Start-End: 42-293
ctcatttcacttcagaatcattcctgtagaatcatcctgtaatggatttgttgtttcagttgttggtgactttcagggatgtggccattgacttctctcaggaggaatgggaatgcctggaccctgctcagagggacttgtacagggatgtgatgttggagaactacagcaacctgatctcattggacttggaatccagttgtgtgaccaaaaagttatctccagaaaaggaaatttatgaaatggaatcactccagtgggagaatatggggaaacgtatcaaccatcacctt

SEQ ID NO: 203027 - DNA, 2904 bp, Homo sapiens
  Payload ID: 20036
  Gene Name: zinc finger protein 571
  Uniprot ID: Q7Z3V5
  ENST ID: ENST00000593133
  CDS Start-End: 730-2559
ggccaggtgagtgggcggcctcaccgggaaccgctcgcagcttttgggttgcttcatcgaaaaagtagttcttgtatggtgctgggaataccggtgtcctggctggggctcggtgctgacaggaacgggacggtgctctggctaattacttatggaagtcggccttgcgcttgcggaggggtgtcggcaccgtcactttggttctggcagtggcgggggtgtggtgctgctagttgtgttcctccgcaccgaatttatgagtgtgcccctggagcccctgccgcggacaaaatcggcaccataactttgggatagggaggctagaaggaggcgggtgttactagtagtgttcctccgccctggacgtgtgcgtgtgcgcttgtgcggccgcggggtgggctcacctgccgcctgttaatgctcctagcgcttggcccctcccgggccgcagtactcctcgtgtgacacggacatcattaagccagctgagaatcgtgcggttacagctgctgcagtttctttgcagagtaagaggctctttttgaagtttccctgatggtgaggctttacccctggaagtgtcttaggaagaagaccactgttaaagatgtcctattctagcttgacagccctgtggggaagactaatccctttctagagcactggcttctctggactttgcacacctccaggagaagaacccagaaaattgatcagttctaaaaaaccatgccccacttgttggtgactttcagggatgtggccattgacttctctcaggaggaatgggaatgcctggaccctgctcagagggacttgtacagggatgtgatgttggagaactacagcaacctgatctcattggacttggaatccagttgtgtgaccaaaaagttatctccagaaaaggaaatttatgaaatggaatcactccagtgggagaatatggggaaacgtatcaaccatcaccttcaatacaatggtcttggagacaatatggagtgcaaaggcaacttagagggtcaagaagcaagtcaggaagggctttacatgtgtgtcaaaattacctgtgaagaaaaggccactgaaagtcattcaacctcttctacttttcatcggataattcctaccaaggaaaaattgtacaaatgtaaggaatgcagacaaggtttcagctacctgtcatgccttattcaacatgaggaaaatcataatatagaaaaatgctctgaagttaagaaacacaggaatacctttagcaaaaagccaagctatattcaacatcagagaattcagactggtgagaaaccttatgagtgtatggaatgtggaaaggcctttggtcgtacttctgatctcattcaacatcagaaaattcatactaatgaaaaaccttatcagtgtaacgcatgtgggaaagcttttattcgtggttcacagctcactgaacatcagagagttcatacaggagagaaaccatatgaatgtaagaaatgtggaaaagcctttagttattgttcacaatatactcttcatcagagaattcatagtggtgaaaaaccctatgaatgtaaggattgtgggaaggcctttattcttggctctcaacttacttaccatcagagaattcatagtggtgagaaaccttatgagtgtaaggaatgtggaaaggcctttattcttggttcacaccttacataccatcagagagttcatactggtgaaaagccttacatatgtaaagaatgtgggaaagcctttttatgtgcctcccaactgaatgaacatcagagaattcatacaggagagaaaccctatgaatgtaaagaatgcgggaagaccttttttcgtggctcacaacttacttaccacctgagagttcattcaggtgagagaccttataaatgcaaagaatgtgggaaagcctttatttctaattctaatcttattcaacatcaaagaattcataccggagagaagccctacaaatgtaaggaatgtggaaaggcctttatttgtggcaaacaacttagtgaacatcagagaattcatacaggtgagaaaccctttgaatgtaaggaatgtggaaaggcctttattcgtgttgcatatcttactcaacatgagaaaattcatggtgagaaacattatgaatgtaaggaatgtgggaagacctttgtacgtgctacacaacttacatatcatcaaagaattcatacaggtgaaaagccctacaaatgtaaggaatgtgacaaggcctttatttatggctcacaacttagtgaacatcagagaattcacagaggtgaaaaaccttatgaatgtaaacagtgtgggaaggcttttattcgtggctcacaccttactgaacatctgagaactcatactggagagaaaccctatgaatgtaaggaatgtgggagggcctttagtcgtggctcagaacttactctgcatcaaaggatccatactggtgagaaaccctatacatgtgtccagtgtggtaaagactttagatgtccttcacaacttactcaacatacaaggcttcataattgagaaagccttgaatgtgattaaatttaagaaaatcttcatctatttcatatctataatgaatgtagaacatcttgcttctgctcagaatctgctcattcttagaaggcctacattaacatggatgcagaataatttcagaaaccccttaaataattccttaacatctctataaacgctagaatataatgctgaattatatcctttattaagcatcatctccatttcaccatatcctaactgaaatcctatatatttcttgtgtgttcttttctatttgtaaaatactgtaattgtattacaatgactaaattataattaaatacatataattccctttcgatagca

SEQ ID NO: 203028 - DNA, 1700 bp, Homo sapiens
  Payload ID: 20036
  Gene Name: zinc finger protein 571
  ENST ID: ENST00000590751
  CDS Start-End: 185-613
gtctgcgccggccagcgcttggcccctcccgggccgcagtactcctcgtgtgacacggacatcattaagccagctgagaatcgtgcggttacagctgctgcagtttctttgcagacactggcttctctggactttgcacacctccaggagaagaacccagaaaattgatcagttctaaaaaaccatgccccacttgttggtgactttcagggatgtggccattgacttctctcaggaggaatgggaatgcctggaccctgctcagagggacttgtacagggatgtgatgttggagaactacagcaacctgatctcattggagccagcccgtacccgcgaagagcaacacaatctgccggtcccaaaagcaggaagtgtcaaccttgcagcaggatttggacactccaggagccaaactggatgtggaagctccaaaggtgcagaaaaaggactccaaaatgttgacttttacctctgtcctgggaatcaccctgacactagctgtcgagatacttaccagtttttctgccctgattggacatgtgtaactttagccacctactctgggggatcaaccagatcttcattccataactcgtgcttctcgtcctaaattatgtactagaaaaaattgtaatcctcttactataactgtccatgaccctaattcaactcagtagtattatggcatgtcatgggaattaagattttatatcccaggatttgatgttgggactatgttcaccatccaaaaaatcctggtctcatggagcccacccaagccaatcgggcctttaactgatctaggtgaccctatgttccagaaaccccctaacaaagttgatttaactgttcctccaccattcttagtcataaaagatacactccaaaagttcgagaaaatctagataggcgccaacaggaacgagaaaacaacatcccctggtatcaaagcatgttcaactggaacccctggctaactactttaatcactgggttagctggacctctcctcatcatactattaagtttaatttttgggccttgtatataaaattggtttcttaattttgtaaaagaatgcatagcttctgtcaaacttatgtatcttaatactcaatataacccccttgttataattgaggaatcaacgatttgattccccaaaaacacaagtggggaatgtaatgcccaaccttgtttttactaaccctgtttttagactctcccttttcctttaattacccagccttgtttccacctgaattgactctcccttagctaagagagccagacagactccatcttggctctttcactggcagccgcttcctcaaggacttaacttgtgcaagctgactcccagcacatccaagaatgcaattaactgataagatactgtggcaagctatatctgcaattcccaggaattcatctgattgataacgcccaaagcccccggtctatcaccttgtaatagtcttaaagcccctgcacctggaactgtttaatttcctgtaaccatttatccttttaactttttgcctactttatttctgtaaaattgttttaactagaccctcccctcccctttctaaaccaaagtataaaagaaaatctagccccttcttcgggccgagagaattttgagcgttagccgtctctcggtcgccagctaataaatggactcttaattcgtc

SEQ ID NO: 203029 - DNA, 3275 bp, Homo sapiens
  Payload ID: 20037
  Gene Name: zinc finger protein 572
  Uniprot ID: Q7Z3I7
  ENST ID: ENST00000319286
  CDS Start-End: 155-1744
tttctgccttccgggtttgagagtttaggaccctgggttggtggggtcagagggagagggggtaccttcctcccggaccgctgggggtgcagggcgccttgggtgtagcacccagaacaggtttctgatctctaacttggctgtgatcattgtgatggagcaagaaaaaaaactgttggtctcagattctaacagctttatggagagggagagtttgaaaagccctttcacaggagatacaagtatgaataatttggaaactgttcaccacaataattctaaggcagataaacttaaagagaaaccttcagaatggtctaaaagacatagaccacaacattataagcatgaggatgcaaaagaaatgccactgacatgggttcaagatgagatttggtgtcatgattcctatgagagtgatggcaagtcagagaattggggaaattttatagctaaagaggaggaaaaacccaatcaccaggaatgggactcaggagaacataccaatgcctgtgtccagcagaattcatcctttgtagacagaccctataaatgttccgaatgttggaaaagcttcagtaatagttctcatttgcgtactcaccagaggacccactcaggagaaaagccttataaatgctctgagtgtgcaaaatgtttttgtaacagttctcacctgattcagcatctaagaatgcacacaggagagaagccctaccagtgtggtgaatgtgggaaaagcttcagcaatacctcccatcttattatccatgagagaactcacacgggagagaaaccctacaaatgtcccgagtgtgggaagagattcagcagcagctctcaccttattcagcatcacagatcacatacaggtgaaaaaccatatgaatgttctgtctgcggaaaaggcttcagtcacagctatgtcctaatagaacatcagaggactcacactggagaaaaaccttataagtgccctgattgtgggaagagttttagtcagagttccagcctcattcgccaccagcggacacacacaggtgagaagccctacaaatgtcttgagtgtgaaaaaagctttggttgtaattctactctaataaaacatcagagaatacatacaggagaaaagccttatcaatgtccagaatgtgggaagaattttagtcgtagttcaaaccttattacacaccagaaaatgcacacaggagagaaatcctatgaaagttctgaatatgaggaaagtttgggtcagaactgcaatgtgatagaagaatgcagaatccagttaggagagaaaccatatagatgttgtgaatgtgggaagagttttggccttagctcccatctcattagacatcagagaacacatacaggagaaaaaccttacagatgttctgagtgctggaaaactttcagtcagagttccaccctggtgattcaccaaaggacacatacaggagagaaaccttataaatgtcctgattgtggtgaaagcttcagtcagagctttaaccttatcaggcaccggaggacccacataggggaaaaaccttacaaatgtaccagctgtgagaaatgcttcagcagaagtgcctacctcagtcagcatcggaaaattcacgtagaaaagccttttgagtctcccgacgttggggattttcctcatgaatggacttggaaaaactgttcaggggaaatgcccttcatctcttcattttccgtctcaaattcatcttcctgagtcccaaagcctggttggtgatggttttttcttccttgttggaccatgacaatttaggtattctgtgattgttgtgctataaagtttctttgatgtgtttgtcaaaacatttggaaaaagtcaacctcccagtttaaaggatgggaagaccccaatcaccaggttattggatctgtccagtgagagattcatccaccaaggatgaagaaaggaggacttttaaaaatttaaggtaagatagtaatagcttcaaaagaacacatacagagtaatcctgagagtaagcaaaggaaccatgagaaccgaagctagaattgctattgaattactttattttctcttcccttattgggtagagatacatcattactggcctcaggggtttacccaaagaaagggtatttttgagcaaataatgtgatttcctggctattttgttgggggcttaagatttttttttttcaaatgcatttttagtcactaaaaattaactgtcgtaccatctagaactatactgtccagtaccatagcctctagccgtatgtagctatttgtattaagattaattgaaattttaaatccagttcctcagtcacactagccactttctaagtgctcagtagctctgtgtgaccagcggctactgtattggatattatagaaggttctttcattcaagatcatcattcttgacagacccataaatatttcctataaagactgtagaagtgtgttctggagggtttgctctccaaaaagaattgtaatatagagtagaattgggatagagtattgaagacactgggtttagacattggatattttaatgattgtgtgttctaattcatgtgctgccaactgagttatctagtgatatgacctcactgtcttgaccaaagccagaatagaaggcaggattcctgaattctatcttaaaatttgcaatgaagagccttttccctaaattatcccattatgtaattcttggtcagctcaagaactgggttctttttctaataattaactcactaaatctgagccagtgtccaaggacagtttgtcattaaggagtactgagacttcttagctttggtactgacagttttcttttgcctcttgacataattggtatatggatctgataactgaggtcccatcttccctactcattcctatgggaatgatgctttggaaattattagatatatcctattcccttcctcccatttttttcctgctagtgcaaaaggtagatgagtaggaagattaggactcctgagttgcccatgatttcatctaatttttggattcagaatgtattttatgaataatatgcagagatgcatattaggaatgtgaagccagaatgggtcagttgtagctgctgcaaagttctgtagctgatggtcatttaattgcatgggggttattttatctttcatgattgtggtgcacctgatgctggcggggtatttgtgtgtttttgtattgttatttgattacaaaaataaagcaaaaactaacaaataaa

SEQ ID NO: 203030 - DNA, 2014 bp, Homo sapiens
  Payload ID: 20038
  Gene Name: zinc finger protein 573
  Uniprot ID: Q86YE8
  ENST ID: ENST00000339503
  CDS Start-End: 1-1824
atggagtcttgctctgtcgcacaggctggagtgcagtggcccgatctcagctcactgcaacctccgcctcccaggttcaagcaattctcctgccacagcctccaagtagctgggattacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtatgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaag

SEQ ID NO: 203031 - DNA, 2124 bp, Homo sapiens
  Payload ID: 20038
  Gene Name: zinc finger protein 573
  Uniprot ID: Q86YE8
  ENST ID: ENST00000357309
  CDS Start-End: 201-1934
acccaatctatggcttcccttccgttttcgcgtggttcttttgcaagctctggattctctggagtttgaatgtttccagtattggaaccccaccaagtaggactgatcaggtcttacaattctaaaaccatgacctgtgaggacattccatttctaaaccagttgtggttgatttactggagcgaggaaaagagccctggatgattttgagggaagaaacacagttcacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtatgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaag

SEQ ID NO: 203032 - DNA, 476 bp, Homo sapiens
  Payload ID: 20038
  Gene Name: zinc finger protein 573
  ENST ID: ENST00000378445
  CDS Start-End: 54-476
cccttccgttttcgcgtggttcttttgcaagctctggattctctggagtttgaatgtttccagtattggaaccccaccaagtaggactgatcaggtcttacaattctaaaaccatgacctgtgaattagtgacattcagggatgtggccatagacttctctcggcaggagtgggaatacctggaccctaatcagagggacttatacagggatgtgatgttggagaactatagaaacctggtatcactgggaggacattccatttctaaaccagttgtggttgatttactggagcgaggaaaagagccctggatgattttgagggaagaaacacagttcacagatttggatttacagtgtgagataatcagctacatagaagtacccacttatgaaacagatatatcctctacacaacttcagagcatatataagagagagaaactctatgaatgtaagaaatgtcagaagaaattt

SEQ ID NO: 203033 - DNA, 2266 bp, Homo sapiens
  Payload ID: 20038
  Gene Name: zinc finger protein 573
  Uniprot ID: Q86YE8
  ENST ID: ENST00000392138
  CDS Start-End: 340-2076
gagtgcgcatgcgcagagcggccaacccgtgagggaacgtttctgacgctaggtcaagggcggtgttcctgtgttcttagggccccaggaggcgagtctgagtggaacctggctggggtaggctgaaaggtgacttcgacgctcttctgaggcctcagacgtgtgtgatgactgccctgtagaatcagtgctgtgaccccgagtaacaacgcgcgcttgagttggtataaactcctgaagtttcaggaattagtgacattcagggatgtggccatagacttctctcggcaggagtgggaatacctggaccctaatcagagggacttatacagggatgtgatgttggagaactatagaaacctggtatcactggatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtatgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaag

SEQ ID NO: 203034 - DNA, 2257 bp, Homo sapiens
  Payload ID: 20038
  Gene Name: zinc finger protein 573
  Uniprot ID: Q86YE8
  ENST ID: ENST00000536220
  CDS Start-End: 70-2067
acccaatctatggcttcccttccgttttcgcgtggttcttttgcaagctctggattctctggagtttgaatgtttccagtattggaaccccaccaagtaggactgatcaggtcttacaattctaaaaccatgacctgttttcaggaattagtgacattcagggatgtggccatagacttctctcggcaggagtgggaatacctggaccctaatcagagggacttatacagggatgtgatgttggagaactatagaaacctggtatcactgggaggacattccatttctaaaccagttgtggttgatttactggagcgaggaaaagagccctggatgattttgagggaagaaacacagttcacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtatgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaag

SEQ ID NO: 203035 - DNA, 2225 bp, Homo sapiens
  Payload ID: 20038
  Gene Name: zinc finger protein 573
  Uniprot ID: Q86YE8
  ENST ID: ENST00000590414
  CDS Start-End: 23-2020
ctctggattctctggagtttgaatgtttccagtattggaaccccaccaagtaggactgatcaggtcttacaattctaaaaccatgacctgttttcaggaattagtgacattcagggatgtggccatagacttctctcggcaggagtgggaatacctggaccctaatcagagggacttatacagggatgtgatgttggagaactatagaaacctggtatcactgggaggacattccatttctaaaccagttgtggttgatttactggagcgaggaaaagagccctggatgattttgagggaagaaacacagttcacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtatgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaagaaaaaaaaaaaaaaa

SEQ ID NO: 203036 - DNA, 2443 bp, Homo sapiens
  Payload ID: 20038
  Gene Name: zinc finger protein 573
  ENST ID: ENST00000586155
  CDS Start-End: 65-379
atctatggcttcccttccgttttcgcgtggttcttttgcaagctctggattctctggagtttgaatgtttccagtattggaaccccaccaagtaggactgatcaggtcttacaattctaaaaccatgacctgttttcaggaattagtgacattcagggatgtggccatagacttctctcggcaggagtgggaatacctggaccctaatcagagggacttatacagggatgtgatgttggagaactatagaaacctggtatcactggagatgaggtctcgctctgttgcccgggttggtctcaaactcctggtctcaagtgatcctcccacctcggccttccaaaatgctgggattataggcgtgagccaccatgcctagccaatagtagtattattatgtccagtttatttgccaaattggaataatgagttgaagtcacatggccaaagtcacaaggaggacattccatttctaaaccagttgtggttgatttactggagcgaggaaaagagccctggatgattttgagggaagaaacacagttcacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtatgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaag

SEQ ID NO: 203037 - DNA, 861 bp, Homo sapiens
  Payload ID: 20038
  Gene Name: zinc finger protein 573
  ENST ID: ENST00000489148
  CDS Start-End: 17-331
attctctggagtttgaatgtttccagtattggaaccccaccaagtaggactgatcaggtcttacaattctaaaaccatgacctgttttcaggaattagtgacattcagggatgtggccatagacttctctcggcaggagtgggaatacctggaccctaatcagagggacttatacagggatgtgatgttggagaactatagaaacctggtatcactggagatgaggtctcgctctgttgcccgggttggtctcaaactcctggtctcaagtgatcctcccacctcggccttccaaaatgctgggattataggcgtgagccaccatgcctagccaatagtagtattattatgtccagtttatttgccaaattggaataatgagttgaagtcacatggccaaagtcacaaggaggacattccatttctaaaccagttgtggttgatttactggagcgaggaaaagagccctggatgattttgagggaagaaacacagttcacaggtgttgaaaagagggactatgatagagaataggaagcaaagagctgatgttttgacatgagacctcctagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatg

SEQ ID NO: 203038 - DNA, 578 bp, Homo sapiens
  Payload ID: 20038
  Gene Name: zinc finger protein 573
  ENST ID: ENST00000591516
  CDS Start-End: 33-365
cttttgcaagctctggattctctggagtttgaatgtttccagtattggaaccccaccaagtaggactgatcaggtcttacaattctaaaaccatgacctgttttcaggaattagtgacattcagggatgtggccatagacttctctcggcaggagtgggaatacctggaccctaatcagagggacttatacagggatgtgatgttggagaactatagaaacctggtatcactgggaggacattccatttctaaaccagttgtggttgatttactggagcgaggaaaagagccctggatgattttgagggaagaaacacagttcacagagatgggggtctcactgggttgctcagctggtctctaactcctgggctcaagcagtcctcctgcattggcttcccaaagtgctgaaaatacaggtgcggtggctcacgcctgtaatcccagcactttgggaggccgaggcgggcggatcacgagtgtgagataatcagctacatagaagtacccacttatgaaacagatatatcctctacacaacttcagagcatatataagagagagaaactctatgaat

SEQ ID NO: 203039 - DNA, 453 bp, Homo sapiens
  Payload ID: 20038
  Gene Name: zinc finger protein 573
  ENST ID: ENST00000585724
  CDS Start-End: 43-177
tcgcgtggttcttttgcaagctctggattctctggagtttgaatgtttccagtattggaaccccaccaagtaggactgatcaggtcttacaattctaaaaccatgacctgtgaggacattccatttctaaaccagttgtggttgatttactggagcgaggaaaagagccctggatgattttgagggaagaaacacagttcacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaa

SEQ ID NO: 203040 - DNA, 2501 bp, Homo sapiens
  Payload ID: 20038
  Gene Name: zinc finger protein 573
  ENST ID: ENST00000589632
  CDS Start-End: 40-417
cgtggttcttttgcaagctctggattctctggagtttgaatgtttccagtattggaaccccaccaagtaggactgatcaggtcttacaattctaaaaccatgacctgtaactggggaagacctttgaagttctgtccaacaaagtatatgaagtttcaggaattagtgacattcagggatgtggccatagacttctctcggcaggagtgggaatacctggaccctaatcagagggacttatacagggatgtgatgttggagaactatagaaacctggtatcactgggaggacattccatttctaaaccagttgtggttgatttactggagcgaggaaaagagccctggatgattttgagggaagaaacacagttcacagagatgggggtctcactgggttgctcagctggtctctaactcctgggctcaagcagtcctcctgcattggcttcccaaagtgctgaaaatacagatggagtcttgctctgtcgcacaggctggagtgcagtggcccgatctcagctcactgcaacctccgcctcccaggttcaagcaattctcctgccacagcctccaagtagctgggattacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtatgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaagaaaaaaaaaaaaaaa

SEQ ID NO: 203041 - DNA, 482 bp, Homo sapiens
  Payload ID: 20038
  Gene Name: zinc finger protein 573
  ENST ID: ENST00000588218
  CDS Start-End: 177-482
ctatggcttcccttccgttttcgcgtggttcttttgcaagatgttgggagccattgagctgaatctcattaacgttctcatatttggccgggtgtggtggctcacgcctgtaatcgcaccattttaggaggccaaggcggacggatcacttgagctctggattctctggagtttgaatgtttccagtattggaaccccaccaagtaggactgatcaggtcttacaattctaaaaccatgacctgtaactggggaagacctttgaagttctgtccaacaaagtatatgaagtttcaggaattagtgacattcagggatgtggccatagacttctctcggcaggagtgggaatacctggaccctaatcagagggacttatacagggatgtgatgttggagaactatagaaacctggtatcactgggaggacattccatttctaaaccagttgtggttgatttactggagcgaggaaaagagccc

SEQ ID NO: 203042 - DNA, 3309 bp, Homo sapiens
  Payload ID: 20039
  Gene Name: zinc finger protein 574
  ENST ID: ENST00000222339
  CDS Start-End: 236-3196
agctgaggagggagggactgaggagccgggcacccagagtggatctgggggaaagaggtggaaaagtgacagagggaagacagcctccaagctcagaggcagagagagggaggaggacaggtgagcggaggcacagaatagaaagagaaatggaaagagacctgccgagggagacttggaaagagggaagccagggtggaggagttctgacagagagagggatctaaacagagacatgccgagagcaacctgggctaacagcaaagagagaagttgggcagagtcagagaggggcccaagagacacaggaaatgggggctcaaaagcggaaagacatatccaggagatagagactggacggggtggggacagggccaaggcccaccgcaggcagaggatgaggctcagaggaacagaaagagccagtctgggaccaggacggaggcttggagacagcaggggcacggacatgccaggggcccgggcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccacctt

SEQ ID NO: 203043 - DNA, 2940 bp, Homo sapiens
  Payload ID: 20039
  Gene Name: zinc finger protein 574
  Uniprot ID: Q6ZN55
  ENST ID: ENST00000359044
  CDS Start-End: 142-2832
gagagcgaggctacggagcaggcgagaggcgacggcgagagctagagcgggcgcagcgttagggtggccgtgcaaggggagccgtggcccgggcccggggcgtgcgagacggcggaagcagcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccacc

SEQ ID NO: 203044 - DNA, 3598 bp, Homo sapiens
  Payload ID: 20039
  Gene Name: zinc finger protein 574
  Uniprot ID: Q6ZN55
  ENST ID: ENST00000600245
  CDS Start-End: 656-3346
gatgagaagaaggagctgcattggatggaaggcccacccccgagccaccccctctaccacaccatgccaccgccctgcccaggcagccctgggcacaggagcccacagagatgagaggcaagaagacccagggagaaggccactgagatgaggggagagggctacagagatgaagagaaatgaagagaagagagacagccgtcaagactgtccagagaagtgggctgaggcccacaaaccccacaaggacaaggacaggaaaagcccagggataagaaagaaaggcccatggagacaagggagcagcctacagagacaagcaaaaggacctcggagacaaggggcagtaatgtggacatagagacctcccgcgaaggaaaacgggagaagccagagacacaagagagaggcccctggaaacagaaagcactcctcagatatggggagcggtccacagggcagggagagagccaaggagagccgaagaaggtcacagaaacaagggaggcctacagacaccagggtaccaaaaagacaaggatgtggctcatagacacaagagagccactgaggcaggagctgccagcctggagatgcggggcaagcctcccccaatataaatagctcctatagagcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgagttgcca

SEQ ID NO: 203045 - DNA, 858 bp, Homo sapiens
  Payload ID: 20039
  Gene Name: zinc finger protein 574
  ENST ID: ENST00000597391
  CDS Start-End: 483-858
aactatacatgcctggtgttagggaatttaatccatgagaaggttaggacatctagtgaccaaatggccatagaattggccccgggtctcactgtgagacgcatcccatagtggcttcagatggagtctcgctctgtcgcccaggcgggagtgcagtggcgtgatctcggctcactgcaacctcggcctcctgggtgcaatcaaatctcgagcctcagcctcccgagttgctggggttacaggcacgagccaccacgcccagctaatgttttgtatttttagtaaagatggtagtttcaccaggttggccaggtgggtctcgaatgcctgacttcaagtgaacccgcctcagcgtcccaaaatgttgggattgcaggcgtgagccaccacgcccagcctggaaacgtttctaacagtactggggcaactccctcccaaggccctgaggggcgcaggaacgagcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccact

SEQ ID NO: 203046 - DNA, 3070 bp, Homo sapiens
  Payload ID: 20039
  Gene Name: zinc finger protein 574
  ENST ID: ENST00000613064
  CDS Start-End: 1292-2926
gcgacggcgagagctagagcgggcgcagcgttagggtggccgtgcaaggggagccgtggcccgggcccggggcgtgcgagacggcggaagcagcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtcccctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagacaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgagttgccagcagtgtgtagagtgg

SEQ ID NO: 203047 - DNA, 1298 bp, Homo sapiens
  Payload ID: 20040
  Gene Name: zinc finger protein 575
  Uniprot ID: Q86XF7
  ENST ID: ENST00000314228
  CDS Start-End: 513-1250
acgaacttgcctgcctggctggcgcacccagcccctccttccattccttcttccccctctctgcagcctctgccagcccgcactgcgcatgctttctgacgccccctttggtccagcgtgggaggaggggatggaaatgaggttgggctaagcagcttgcgcgcgctcccttgcctgccctcccccgacgccggacgcgcgccgggcggggcagctccgctggtccgagggcagtgcagcagcggcgacagcggctgcggccgtggccgtggcgggaggagccggaagccccgcccccggggaggggccgtcctgcaggtcccccctctatcctccacggccccatccaagccagggatgaaatttaacggcaagaagggcgcagttgacgcggcgtcaatgaactgagactaagtcaaaagccgggccctccaaccctatccccatcagcctggtcatcaccggcgtcacccccgccccgcgccctgcccctaggttcctgtgccagcaagatgctggagcgaggcgcggagtccgcggccggggctaccgatcctagtcccactggcaaggaaccagtgaccaaagaagctccccaccagggcccaccgcagaagcccagccagtcagctccagggcccaccgcgtccgcgggctcgcctccccggcctcgccggcggcccccgccccagcgcccgcaccgctgccccgactgtgacaaggccttctcgtacccgtccaagctggccacgcaccgcttagcacacggaggcgcccgaccccacccatgcccagactgccccaaggccttctcctacccctccaagctggcagcccaccgcctcacgcacagcggcgcccgcccgcacccgtgcccacactgcccgaagtcctttggccaccgctccaagctggcggctcacctctggacccacgcacccacccgcccctacccgtgccccgactgccccaagtccttctgctacccttccaagctggcggcccaccgccacacgcaccacgccaccgacgcccgcccctatccttgcccgcattgccccaaggctttctcatttccctccaagctggccgcccatcgcctatgtcacgaccccccaaccgcgcccggcagccaggcgactgcctggcaccgatgctccagctgcggccaggcctttggccagagacgcttactgctccttcatcaacgcagccaccaccaggtggagcacaagggggagagagactgagccctcccttggctcactgtccccttctgccgccagccctagccagta

SEQ ID NO: 203048 - DNA, 2285 bp, Homo sapiens
  Payload ID: 20040
  Gene Name: zinc finger protein 575
  ENST ID: ENST00000458714
  CDS Start-End: 808-1842
agctgtttccctctctctgagggcaactcccctggccctccctccttcggcctggttgcaattctggccggaaacccgctggtgcctgtggcaaataaagtgaggaaggcaggaacctttagacttcccagtgtgaggcaacggcagggctaggactagggtgaggctgttggtgcaagatttaaggaggcgctcactcacaggtgcggaccctgcacttacaggaccctgagagcgagtgcctccttaaatgttgcactccagggtcctcaccgtccttttcctagtcctgggctccgggttctaagcacccagatgctccttcctcaaacggaggtttccgcaagacaggactgggtctctttccttctcagccctgccctcagaattccagcccctaatcaacttttatggagatgcatgccaggccaaagggctgcccctaagctttaggaaggaaactccttaaatgctgttgacttaggagttccgccagtgccccacctgcccagagcctcttgccccagtgccccacctgggtttatggtgcccccctcccagaaatatgagctcaggggtcagaaacccaggtcctgaggtccctcctccccaaggactcaggatcccaggcccccagtcccctcttcccttaagtttaagaagtccaggccaccaccctcttggggacccagcacccaactcacgaagcgcccgaagcggatggagtctccatcctcaatgtactcaggagttctgggccccagcttcccattccactgacgctgcagcccagccccgctgggatccatgagtttggtccccggactgaccagcatagagcagccgcagccccagctccttgatcagctgggcatcccgaggcgctgtttccaggactgggtcgatcagaacggcctcccgggactctctgtcacccagcagatacggggtatcactctgttgcgcaggctggaatgcagtaacacaatcatagctcattgcagacatgaactcctgggccctccaaccctatccccatcagcctggtcatcaccggcgtcacccccgccccgcgccctgcccctaggttcctgtgccagcaagatgctggagcgaggcgcggagtccgcggccggggctaccgatcctagtcccactggcaaggaaccagtgaccaaagaagctccccaccagggcccaccgcagaagcccagccagtcagctccagggcccaccgcgtccgcgggctcgcctccccggcctcgccggcggcccccgccccagcgcccgcaccgctgccccgactgtgacaaggccttctcgtacccgtccaagctggccacgcaccgcttagcacacggaggcgcccgaccccacccatgcccagactgccccaaggccttctcctacccctccaagctggcagcccaccgcctcacgcacagcggcgcccgcccgcacccgtgcccacactgcccgaagtcctttggccaccgctccaagctggcggctcacctctggacccacgcacccacccgcccctacccgtgccccgactgccccaagtccttctgctacccttccaagctggcggcccaccgccacacgcaccacgccaccgacgcccgcccctatccttgcccgcattgccccaaggctttctcatttccctccaagctggccgcccatcgcctatgtcacgaccccccaaccgcgcccggcagccaggcgactgcctggcaccgatgctccagctgcggccaggcctttggccagagacgcttactgctccttcatcaacgcagccaccaccaggtggagcacaagggggagagagactgagccctcccttggctcactgtccccttctgccgccagccctagccagtaagaggtgggatttctaagaccgactgtatgagctcgcctcttccagatagctggcagagggcagggcaagggattggccatttatactgggctcgagctcagaagcccgaggaactctttgctcccctgctttggggagatctcaaaccatggacgtggagctgtggtttgacagcgctggctctgcttctccccacacacttacatggcaaaggtaaaaagtctgctactatcgtgggttgatgaggattgtgggcaaacaggctctcttgttaaaagtttaaactggtgtctccactttggccatatgacggtatctaagaaattgaaaatacatacatgcttgtctcaactcttccacttgtaggaatttattctataaactcatgaatgtg

SEQ ID NO: 203049 - DNA, 536 bp, Homo sapiens
  Payload ID: 20040
  Gene Name: zinc finger protein 575
  ENST ID: ENST00000598080
  CDS Start-End: 234-536
agactttttgcaaacgccttgaagggtagaattagcagcgagctcttgaaactgcctctggagatggaactcagcggaattctcgaaaagaagagggacattaaaaagacgggtgcatgcactgatttccaagcgcagtttgtccatgccctccaaccctatccccatcagcctggtcatcaccggcgtcacccccgccccgcgccctgcccctaggttcctgtgccagcaagatgctggagcgaggcgcggagtccgcggccggggctaccgatcctagtcccactggcaaggaaccagtgaccaaagaagctccccaccagggcccaccgcagaagcccagccagtcagctccagggcccaccgcgtccgcgggctcgcctccccggcctcgccggcggcccccgccccagcgcccgcaccgctgccccgactgtgacaaggccttctcgtacccgtccaagctggccacgcaccgcttagcacacggaggcgcccgaccccacccatgcccagactgccccaaggccttctcc

SEQ ID NO: 203050 - DNA, 1086 bp, Homo sapiens
  Payload ID: 20040
  Gene Name: zinc finger protein 575
  Uniprot ID: Q86XF7
  ENST ID: ENST00000601282
  CDS Start-End: 235-972
ggcagctccgctggtccgagggcagtgcagcagcggcgacagcggctgcggccgtggccgtggcgggaggagccggaagccccgcccccggggaggggccgtcctgcaggtcccccctctatcctccacggccccatccaagccagggatgaaatttaacggcaagaagggcgcagttgacgcggcgtcaatgaactgagactaagtcaaaagccgggttcctgtgccagcaagatgctggagcgaggcgcggagtccgcggccggggctaccgatcctagtcccactggcaaggaaccagtgaccaaagaagctccccaccagggcccaccgcagaagcccagccagtcagctccagggcccaccgcgtccgcgggctcgcctccccggcctcgccggcggcccccgccccagcgcccgcaccgctgccccgactgtgacaaggccttctcgtacccgtccaagctggccacgcaccgcttagcacacggaggcgcccgaccccacccatgcccagactgccccaaggccttctcctacccctccaagctggcagcccaccgcctcacgcacagcggcgcccgcccgcacccgtgcccacactgcccgaagtcctttggccaccgctccaagctggcggctcacctctggacccacgcacccacccgcccctacccgtgccccgactgccccaagtccttctgctacccttccaagctggcggcccaccgccacacgcaccacgccaccgacgcccgcccctatccttgcccgcattgccccaaggctttctcatttccctccaagctggccgcccatcgcctatgtcacgaccccccaaccgcgcccggcagccaggcgactgcctggcaccgatgctccagctgcggccaggcctttggccagagacgcttactgctccttcatcaacgcagccaccaccaggtggagcacaagggggagagagactgagccctcccttggctcactgtccccttctgccgccagccctagccagtaagaggtgggatttctaagaccgactgtatgagctcgcctcttccagatagctggcagagggcaggg

SEQ ID NO: 203051 - DNA, 2566 bp, Homo sapiens
  Payload ID: 20041
  Gene Name: zinc finger protein 576
  Uniprot ID: Q9H609
  ENST ID: ENST00000336564
  CDS Start-End: 155-667
cctgggagcaggaacctgtaggcagcgcttgagggtagcgggatagcagctgcaagcgcgcgtgggaggcgggggctctgggcggaacaaaaatcacaggatgtcagaggatgtttcccgggaagaactgggataaaggaagggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattcttatttagagcttcagtctttggagcacacagggccttcgtgagacagtgaaatcagataataatgagatcttttgttaaaaaaaaaaaatgggaagggagtgcgggagagaaatggtttgtgtctcccttattcccagttaaatacctagctgcagattgtgccatcacccttcattcttcccagatggatgccatgggctatgggagcaaattgccctggacctttgcctgaatgggggcaggaaaggtgaggtgttgctggcctgtaatgccaccaggtgagttccagatgtggagcaacttgggcttttggggatggggcagcaaagttgggagctggaccccaattgagtgggggtagcaattggagtccttgtgtctcttttccaccccctgccatcctcacttagaggggccatggcactagatggcactagtcccccgataatttatgtctcgttgaaataattttgtatatcattctagtcctgaaatatttttttcatatgtgtaggtgaaatggtatgaataagctaacaggaatagtatctaaaaacagaaaacatccatattaaaatgtctaaacagggagctctggcttttgagtgggaatttccagagaacataagggtgtgggcaggtgggggaactcaggccagagttggcctcgctttgtggggaaactggtttggaatcaaacagagataccttctgtttcgggttttatttggccaacactgggagatttcccattaagatcctattttcagctctcttgaaaggcccaacctaggctgacattgtcagcaggggcaggacagaagttacaacaggctggagggagcagtgggtgtcaccctcaactggagatgagtcccaccaggccagttttacccccttagttacctgccctgcacctgcagacaatggtcgatgccttgcatataatacttatagactctgtttatgttgagggatgtttttaaagcccacaggtgaggtggatgtggtagactgatcactgtctctgtttttagctaggcacacagtagctgaaaagactgcatttcccagattcctttgcagctagatgtggccttgtgactgatttctggctaaattcctgggtagaacagtcaagcttaagaaagggacggctgggcacagtggctcacgcctgtaatcccagcactttgtgaggctgaggccggtggatcacctgaggtcaggagtttgagaccagcctggccaacatggtgaaaccctgtctctaccaaaaatacaaaaattagccgggtgtggtggcatatgcctgtaatcccagctacttgggaggctgaggcaggagaattgcttgaacctgggagacaggttgcagtgagccaagatcgtgccattgcacttcagcctgggtgacagagtgagactgtttaaaaaaaaagaaaagaaagggacataccttttttccaccttcctaactgtaatacggaaatggtatccagccatctcagaccataaggataagagcaacacgtgggaagacagagcaacaagataggagcctgggtctctcgtcaatttcaaggagcacagccaccataccagcccacttccatattgctatctaagaaagaaacttctatcttatttaagccaccattattttgggtctctgtcacatgcaacagaatttacagcctaagacaggggtctgcaaactatggccaactctagcctgctgcct

SEQ ID NO: 203052 - DNA, 1468 bp, Homo sapiens
  Payload ID: 20041
  Gene Name: zinc finger protein 576
  Uniprot ID: Q9H609
  ENST ID: ENST00000391965
  CDS Start-End: 210-722
attttgaggaccgggctggtgcgactatactactgccggatggcaaatccgggatctcggctccgagaggctcatctggcaaaagggcgcggaaaccacgggggccctgagactgagtggtccctatcccacttctctctggggcggcgctgtagccagcggctgacaggcgcagcgaaaggcagccctctgctaagggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattcttatttagagcttcagtctttggagcacacagggccttcgtgagacagtgaaatcagataataatgagatcttttgttaaaaaaaaaaaatgggaagggagtgcgggagagaaatggtttgtgtctcccttattcccagttaaatacctagctgcagattgtgccatcacccttcattcttcccagatggatgccatgggctatgggagcaaattgccctggacctttgcctgaatgggggcaggaaaggtgaggtgttgctggcctgtaatgccaccaggtgagttccagatgtggagcaacttgggcttttggggatggggcagcaaagttgggagctggaccccaattgagtgggggtagcaattggagtccttgtgtctcttttccaccccctgccatcctcacttagaggggccatggcactagatggcactagtcccccgataatttatgtctcgttgaaataattttgtatatcattctagtcctgaaatatttttttcatatgtgtaggtgaaatggtatgaataagctaacaggaatagtatctaaaaacagaaaacatccatattaaaatgtctaaacaggga

SEQ ID NO: 203053 - DNA, 830 bp, Homo sapiens
  Payload ID: 20041
  Gene Name: zinc finger protein 576
  Uniprot ID: Q9H609
  ENST ID: ENST00000529930
  CDS Start-End: 162-674
aaaactgaggcctgggagcaggaacctgtaggcagcgcttgagggtagcgggatagcagctgcaagcgcgcgtgggaggcgggggctctgggcggaacaaaaatcacaggatgtcagaggatgtttcccgggaagaactgggataaaggggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattctta

SEQ ID NO: 203054 - DNA, 867 bp, Homo sapiens
  Payload ID: 20041
  Gene Name: zinc finger protein 576
  Uniprot ID: Q9H609
  ENST ID: ENST00000533118
  CDS Start-End: 119-631
gcggaaaccacgggggccctgagactgagtggtccctatcccacttctctctggggcggcgctgtagccagcggctgacaggcgcagcgaaaggcagccctctgctggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattcttatttagagcttcagtctttggagcacacagggccttcgtgagacagtgaaatcagataataatgagatcttttgttaaaaa

SEQ ID NO: 203055 - DNA, 859 bp, Homo sapiens
  Payload ID: 20041
  Gene Name: zinc finger protein 576
  Uniprot ID: Q9H609
  ENST ID: ENST00000528387
  CDS Start-End: 80-592
agccctctgctgtaaggaggaaaactgaggcctgggagcaggaacctgtaggcagcgcttgaggaagggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattcttatttagagcttcagtctttggagcacacagggccttcgtgagacagtgaaatcagataataatgagatcttttgttaaaaaaaaaaaatgggaagggagtgcgggagagaaa

SEQ ID NO: 203056 - DNA, 2327 bp, Homo sapiens
  Payload ID: 20041
  Gene Name: zinc finger protein 576
  Uniprot ID: Q9H609
  ENST ID: ENST00000525771
  CDS Start-End: 703-1215
ctggtgcgactatactactgccggatggcaaatccgggatctcggctccgagaggctcatctggcaaaagggcgcggaaaccacgggggccctgagactgagtggtccctatcccacttctctctggggcggcgctgtagccagcggctgacaggcgcagcgaaaggcagccctctgctgtaaggaggaaaactgaggcctgggagcaggaacctgtaggcagcgcttgagggtagcgggatagcagctgcaagcgcgcgtgggaggcgggggctctgggcggaacaaaaatcacaggatgtcagaggatgtttcccgggaagaactgggataaagggtgggtatcactacctgccccaagacacttgagattgggatgacgctggtgtcaaagatcaaggcttccacgctgagttcagggagttagtttgatgcagcaggtcataggtcacaccagtgagaagactctaggggagtcccaaacccaggaaatccagtcctttgggaggtttgaagcttcttttagcaagaactccatcaattagagttcaaggagatagtatgtcgtaggggtcaaaggcaggcaaggagagcctctggcgatgtcaaaggtcatagacttagggtgccctctaagactggtaacagatgaacagcttcacttatgcacgctcctctcctgactagaagggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattcttatttagagcttcagtctttggagcacacagggccttcgtgagacagtgaaatcagataataatgagatcttttgttaaaaaaaaaaaatgggaagggagtgcgggagagaaatggtttgtgtctcccttattcccagttaaatacctagctgcagattgtgccatcacccttcattcttcccagatggatgccatgggctatgggagcaaattgccctggacctttgcctgaatgggggcaggaaaggtgaggtgttgctggcctgtaatgccaccaggtgagttccagatgtggagcaacttgggcttttggggatggggcagcaaagttgggagctggaccccaattgagtgggggtagcaattggagtccttgtgtctcttttccaccccctgccatcctcacttagaggggccatggcactagatggcactagtcccccgataatttatgtctcgttgaaataattttgtatatcattctagtcctgaaatatttttttcatatgtgtaggtgaaatggtatgaataagctaacaggaatagtatctaaaaacagaaaacatccatattaaaatgtctaaacagggagctctggcttttgagtgggaatttccagagaacataagggtgtgggcaggtgggggaactcaggccagagttggcctcgctttgtggggaaactggtttggaatcaaacagagataccttctgtttcgggttttatttggccaacactgggagatttcccattaagatcctattttcagctctcttgaaaggcccaacctaggctgacattgtcagcaggggcaggacagaagttacaacaggctggagggagcagtgggtgtcaccctcaactggagatgagtcccaccaggccagttttacccccttagttacctgccctgcacctgcagacaatggtcgatgccttgcatataatacttatag

SEQ ID NO: 203057 - DNA, 3074 bp, Homo sapiens
  Payload ID: 20042
  Gene Name: zinc finger protein 577
  Uniprot ID: Q9BSK1
  ENST ID: ENST00000301399
  CDS Start-End: 367-1824
gaaacttgcgagtgtcgcgtctgcagtgtgtggggttcgcggggcggcgggtagagttgagcatttttgtcatctgcaaataattttagccaggtggcaagtgtatggactgtggagtaagaagtacctgcctctgcctctgacttgggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccaggttttgtaatccagagtagaagatatgcaggaaaagattctgatgcatttggtggatatgggagatcatgcctccatatcaagcgtgacaaaactcttactggagttaaataccatagatgtgttaaacccagcagccctaaatcacagctcaatgacctacaaaaaatttgtgcaggagggaaaccacatgaatgcagtgtgtgcgggagagccttctccaggaaagcacagcttattcaacatcagagaactgaaagaggagagaaaccccatggatgtggtgaatgtgggaaaacattcatgaggaagattcagctcactgagcatcagagaactcacacaggagagaagccccatgaatgtagtgaatgtggaaaagccttctccagaaagtcacagctcatggtccatcagagaacccatacaggagagaaaccctacagatgcagcaaatgcggaaaagccttcagccggaagtgccggctcaatagacatcagcgatcacatactggagagaaactctatgggtgcagtgtgtgtgggaaagccttttctcagaaggcatacctcactgcacaccagagacttcacacaggagataagccttataaatgcagtgattgtggaagaaccttctattttaagtcagacctgaccagacatcagaggattcatacgggagagaaaccttatgaatgtagtgagtgtgaaaaagcctttagaagcaagtcgaagctcattcagcatcagcgtactcacactggagagagaccatattcatgcagagaatgtggcaaagcctttgcccacatgtcagtcctcattaaacatgagaaaactcacataagagagacagccataaattcactgacggtggagaaaccttcctcaaggagtcatacctccttatacatgagcgaactcatacaagagcaaaagactgtgaacacagtacctatagaaatgccttcctcaggaaccccgccattgttaaacaagagtgagcgcctagtgggcagaaatgtagtgattgtggaacaaccttttccaagaaatcaagcctttgtagttaatcaggaatttgaacagagaataagcctcacaaatgaagtgaatgtggccccatcagtaataaattatatcttgtatcttacagatattgtatcagaataaatcttctgataccagaaaggtgggaaaatctttagtaggaatcctccagccattatatcccagagagctcatttagggctgaaacactgtggaggcagtggttgtggaggacatttctgtgagaagtcaaacctgttaaacaccattgaaatcatgttgggtagaaatgcagctgttatgaggaagtctttacctggagatgatatctcaattggtatcaaaagaattcttacaggaatatttatgaaagattgtgatggtgcttttagcgctaaattgtgcctcgtgtgccaaagaaacatagacaactgtagaggcaatggatatggaaaacatttttcgtaaaatatgggagaatttgtagaaaagaaaaactcttgaaagtaagaaatgatggcaactcaccaaattaactcatgtatcatacttttatgtcttgagagtcttggagggacgtgtttaatgaaatcttgaaccccaggaatagtattatgtaatgaaaacctatgaatataacaaatatggaagtaaaattgtgttagttttttatgagtgttgcaccaaactaacacaaatttaatggcttaaaacaacacaaaatcattatcttacagttctggaggactgaagtccaaatgcatctcacggggctacatcaagctgttgacagggctgcttttctttttggaggctctaggggagcgtctttctttgcccttccagcttctagaagctgcccaaattctgtggtttggggcctcctttcaaaaccagcaatggccaatcagtcttacatcactcaaacacttgagtgttctgtctccctcttccatgtttgaggacccttgtgattacactgtgaaaacccagataagccaggataatctccctatcttattatgaggcaagtatgttaagattttattctataatcagagaatcttatgctatgattgttatatgtgagcattatagatgctcttgaaatgttaaaatcacatcagcactggaaaataactcctaaatgtccaaaaagaacatgagatttatggtgcttgaaatgttgctaaacgtaaatttgtatctattctgaaattatataaattaacctacctggccaggcacagtggctcacacctgtaatctcagcactttgggaggccaaggcaggaagatcacttgagcccgcaagtttgagaccaccctgggcaacatagcgagactacctctacaaaaaaaaaaaaaaataa

SEQ ID NO: 203058 - DNA, 1771 bp, Homo sapiens
  Payload ID: 20042
  Gene Name: zinc finger protein 577
  Uniprot ID: Q9BSK1
  ENST ID: ENST00000451628
  CDS Start-End: 416-1696
cgcgtctgcagtgtgtggggttcgcggggcggcgggtagaggcgagtgtttagagacttcgggtccctgactcgcctccagcagtggagacaggtcatcggtctgttgagcatttttgtcatctgcaaataattttagccaggtggcaagtgtatggactgtggagtaagaagtacctgcctctgcctctgacttgggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccaggagggaaaccacatgaatgcagtgtgtgcgggagagccttctccaggaaagcacagcttattcaacatcagagaactgaaagaggagagaaaccccatggatgtggtgaatgtgggaaaacattcatgaggaagattcagctcactgagcatcagagaactcacacaggagagaagccccatgaatgtagtgaatgtggaaaagccttctccagaaagtcacagctcatggtccatcagagaacccatacaggagagaaaccctacagatgcagcaaatgcggaaaagccttcagccggaagtgccggctcaatagacatcagcgatcacatactggagagaaactctatgggtgcagtgtgtgtgggaaagccttttctcagaaggcatacctcactgcacaccagagacttcacacaggagataagccttataaatgcagtgattgtggaagaaccttctattttaagtcagacctgaccagacatcagaggattcatacgggagagaaaccttatgaatgtagtgagtgtgaaaaagcctttagaagcaagtcgaagctcattcagcatcagcgtactcacactggagagagaccatattcatgcagagaatgtggcaaagcctttgcccacatgtcagtcctcattaaacatgagaaaactcacataagagagacagccataaattcactgacggtggagaaaccttcctcaaggagtcatacctccttatacatgagcgaactcatacaagagcaaaagactgtgaacacagtacctatagaaatgccttcctcaggaaccccgccattgttaaacaagagtgagcgcctagtgggcagaaatgtagtgattgtggaacaaccttttccaagaaatcaagcctttgtagttaatcaggaatttgaacagagaataagcctcacaaatgaagtgaatgtggccccatcagtaataaattatatcttgtatcttacagatattgtatcagaataaatcttctgataccagaaaggtgggaaaatctttagtaggaatcctccagccattatatcccagagagctcattta

SEQ ID NO: 203059 - DNA, 1865 bp, Homo sapiens
  Payload ID: 20042
  Gene Name: zinc finger protein 577
  ENST ID: ENST00000412216
  CDS Start-End: 1350-1685
gaaacttgcgagtgtcgcgtctgcagtgtgtggggttcgcggggcggcgggtagaggcgagtgtttagagacttcgggtccctgactcgcctccagcagtggagacaggtcatcggtctggtctgcgtgggcttctgggaatgtttcaggggcagggagagcgcgcttttttttttctgttgttcgctagcgcgtgaggtccgtgttgcggggagctctcggggagtcctcgctcggagttcgtttcgcagtcgtgttggagttcccagagtctgggagcccatggtctccgcattggaaccagtgcttgggaggtcttcgttgcacagtagcgctagggcgtcgtggtggggaagcgaatcgtgtcagtgttggagactgctctgggcagttcgtgttcattgcttatcacatgcgtacttaaaaaggggtctgctggtccccttgcttccctgctgctgtatattctgtagaaaatgggttttcaggttcattgcgacccaagtaataacatccccatcattttaaatactcctccagaaaataactctggtttagtgtatttcatgtttaatgttgggatcaggtgtctaggtattggtataattttattcgtctttaataacatcttgtcaacttcgtattcccatattacatgctctttgagagttttttaaattgctgcagtttcatcaagtggttgctttaatttgggtagaattgatgtagatctagatacaacactttcaggaacatgtgatggatttctattaacccaatatttttatttgtttgactatctgtagtgtttttccatacgtatcttggacatttctggttatgcttatttctacatagttaatactttttgttgtaaatcgtgactttttttttgcataagacccctccccctttccttttttgttcctaattttacttagttgacaagaacagaagttaaaaatatatatgtttattctgtcacttcattgtactcatgtcattacatataacttataaattgacgtcttttttctagttgagcatttttgtcatctgcaaataattttagccaggtggcaagtgtatggactgtggagtaagaagtacctgcctctgcctctgacttgggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccagggtattcattcaggagaaggaccctacagatggagggaatgcaggaaagctaagaagaatcacacctcattgcagatctgcattaccgttggaaaacagcagcctcagaaccacagtagccatgaagaccatcagccttcaaccaccacccttgtatcagaggagacaaataagcttggaaatcctcaaaaagcctcatcctcagagcaatgtcattatatatcttgtcttac

SEQ ID NO: 203060 - DNA, 2758 bp, Homo sapiens
  Payload ID: 20042
  Gene Name: zinc finger protein 577
  ENST ID: ENST00000458390
  CDS Start-End: 1319-2758
ggggttcgcggggcggcgggtagaggcgagtgtttagagacttcgggtccctgactcgcctccagcagtggagacaggtcatcggtctggtctgcgtgggcttctgggaatgtttcaggggcagggagagcgcgcttttttttttctgttgttcgctagcgcgtgaggtccgtgttgcggggagctctcggggagtcctcgctcggagttcgtttcgcagtcgtgttggagttcccagagtctgggagcccatggtctccgcattggaaccagtgcttgggaggtcttcgttgcacagtagcgctagggcgtcgtggtggggaagcgaatcgtgtcagtgttggagactgctctgggcagttcgtgttcattgcttatcacatgcgtacttaaaaaggggtctgctggtccccttgcttccctgctgctgtatattctgtagaaaatgggttttcaggttcattgcgacccaagtaataacatccccatcattttaaatactcctccagaaaataactctggtttagtgtatttcatgtttaatgttgggatcaggtgtctaggtattggtataattttattcgtctttaataacatcttgtcaacttcgtattcccatattacatgctctttgagagttttttaaattgctgcagtttcatcaagtggttgctttaatttgggtagaattgatgtagatctagatacaacactttcaggaacatgtgatggatttctattaacccaatatttttatttgtttgactatctgtagtgtttttccatacgtatcttggacatttctggttatgcttatttctacatagttaatactttttgttgtaaatcgtgactttttttttgcataagacccctccccctttccttttttgttcctaattttacttagttgacaagaacagaagttaaaaatatatatgtttattctgtcacttcattgtactcatgtcattacatataacttataaattgacgtcttttttctagttgagcatttttgtcatctgcaaataattttagccaggtggcaagtgtatggactgtggagtaagaagtacctgcctctgcctctgacttgggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccaggttttgtaatccagagtagaagatatgcaggaaaagattctgatgcatttggtggatatgggagatcatgcctccatatcaagcgtgacaaaactcttactggagttaaataccatagatgtgttaaacccagcagccctaaatcacagctcaatgacctacaaaaaatttgtgcaggagggaaaccacatgaatgcagtgtgtgcgggagagccttctccaggaaagcacagcttattcaacatcagagaactgaaagaggagagaaaccccatggatgtggtgaatgtgggaaaacattcatgaggaagattcagctcactgagcatcagagaactcacacaggagagaagccccatgaatgtagtgaatgtggaaaagccttctccagaaagtcacagctcatggtccatcagagaacccatacaggagagaaaccctacagatgcagcaaatgcggaaaagccttcagccggaagtgccggctcaatagacatcagcgatcacatactggagagaaactctatgggtgcagtgtgtgtgggaaagccttttctcagaaggcatacctcactgcacaccagagacttcacacaggagataagccttataaatgcagtgattgtggaagaaccttctattttaagtcagacctgaccagacatcagaggattcatacgggagagaaaccttatgaatgtagtgagtgtgaaaaagcctttagaagcaagtcgaagctcattcagcatcagcgtactcacactggagagagaccatattcatgcagagaatgtggcaaagcctttgcccacatgtcagtcctcattaaacatgagaaaactcacataagagagacagccataaattcactgacggtggagaaaccttcctcaaggagtcatacctccttatacatgagcgaactcatacaagagcaaaagactgtgaacacagtacctatagaaatgccttcctcaggaaccccgccattgttaaacaagagtgagcgcctagtgggcagaaatgtagtgattgtggaacaaccttttccaagaaatcaagcctttgtagttaatcaggaatttgaacagagaataagcctcacaaatgaagtgaatgtggccccatcagtaataaattatatcttgtatcttaca

SEQ ID NO: 203061 - DNA, 512 bp, Homo sapiens
  Payload ID: 20042
  Gene Name: zinc finger protein 577
  ENST ID: ENST00000419138
  CDS Start-End: 380-512
atggccctcgccggccgccatccccgaaacttgcgagtgtcgcgtctgcagtgtgtggggttcgcggggcggcgggtagagttgagcatttttgtcatctgcaaataattttagccaggtggcaagtgtatggactgtggagtaagaagtacctgcctctgcctctgacttgggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcaga

SEQ ID NO: 203062 - DNA, 3148 bp, Homo sapiens
  Payload ID: 20042
  Gene Name: zinc finger protein 577
  Uniprot ID: Q9BSK1
  ENST ID: ENST00000420592
  CDS Start-End: 1335-2615
cgcgtctgcagtgtgtggggttcgcggggcggcgggtagaggcgagtgtttagagacttcgggtccctgactcgcctccagcagtggagacaggtcatcggtctggtctgcgtgggcttctgggaatgtttcaggggcagggagagcgcgcttttttttttctgttgttcgctagcgcgtgaggtccgtgttgcggggagctctcggggagtcctcgctcggagttcgtttcgcagtcgtgttggagttcccagagtctgggagcccatggtctccgcattggaaccagtgcttgggaggtcttcgttgcacagtagcgctagggcgtcgtggtggggaagcgaatcgtgtcagtgttggagactgctctgggcagttcgtgttcattgcttatcacatgcgtacttaaaaaggggtctgctggtccccttgcttccctgctgctgtatattctgtagaaaatgggttttcaggttcattgcgacccaagtaataacatccccatcattttaaatactcctccagaaaataactctggtttagtgtatttcatgtttaatgttgggatcaggtgtctaggtattggtataattttattcgtctttaataacatcttgtcaacttcgtattcccatattacatgctctttgagagttttttaaattgctgcagtttcatcaagtggttgctttaatttgggtagaattgatgtagatctagatacaacactttcaggaacatgtgatggatttctattaacccaatatttttatttgtttgactatctgtagtgtttttccatacgtatcttggacatttctggttatgcttatttctacatagttaatactttttgttgtaaatcgtgactttttttttgcataagacccctccccctttccttttttgttcctaattttacttagttgacaagaacagaagttaaaaatatatatgtttattctgtcacttcattgtactcatgtcattacatataacttataaattgacgtcttttttctagttgagcatttttgtcatctgcaaataattttagccaggtggcaagtgtatggactgtggagtaagaagtacctgcctctgcctctgacttgggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccaggagggaaaccacatgaatgcagtgtgtgcgggagagccttctccaggaaagcacagcttattcaacatcagagaactgaaagaggagagaaaccccatggatgtggtgaatgtgggaaaacattcatgaggaagattcagctcactgagcatcagagaactcacacaggagagaagccccatgaatgtagtgaatgtggaaaagccttctccagaaagtcacagctcatggtccatcagagaacccatacaggagagaaaccctacagatgcagcaaatgcggaaaagccttcagccggaagtgccggctcaatagacatcagcgatcacatactggagagaaactctatgggtgcagtgtgtgtgggaaagccttttctcagaaggcatacctcactgcacaccagagacttcacacaggagataagccttataaatgcagtgattgtggaagaaccttctattttaagtcagacctgaccagacatcagaggattcatacgggagagaaaccttatgaatgtagtgagtgtgaaaaagcctttagaagcaagtcgaagctcattcagcatcagcgtactcacactggagagagaccatattcatgcagagaatgtggcaaagcctttgcccacatgtcagtcctcattaaacatgagaaaactcacataagagagacagccataaattcactgacggtggagaaaccttcctcaaggagtcatacctccttatacatgagcgaactcatacaagagcaaaagactgtgaacacagtacctatagaaatgccttcctcaggaaccccgccattgttaaacaagagtgagcgcctagtgggcagaaatgtagtgattgtggaacaaccttttccaagaaatcaagcctttgtagttaatcaggaatttgaacagagaataagcctcacaaatgaagtgaatgtggccccatcagtaataaattatatcttgtatcttacagatattgtatcagaataaatcttctgataccagaaaggtgggaaaatctttagtaggaatcctccagccattatatcccagagagctcatttagggctgaaacactgtggaggcagtggttgtggaggacatttctgtgagaagtcaaacctgttaaacaccattgaaatcatgttgggtagaaatgcagctgttatgaggaagtctttacctggagatgatatctcaattggtatcaaaagaattcttacaggaatatttatgaaagattgtgatggtgcttttagcgctaaattgtgcctcgtgtgccaaagaaacatagacaactgtagaggcaatggatatggaaaacatttttcgtaaaatatgggagaatttgtagaaaagaaaaactcttgaaagtaagaaatgatggcaactcaccaaattaactcatgtatcatacttttatgtcttgagagtcttggagggacgtgtttaatgaaatcttgaaccccaggaatagtattatgtaatgaaaacctatgaatataacaaatatggaagtaaaa

SEQ ID NO: 203063 - DNA, 523 bp, Homo sapiens
  Payload ID: 20042
  Gene Name: zinc finger protein 577
  ENST ID: ENST00000453272
  CDS Start-End: 337-523
cactcaggagagaaaccctataaatgcagtgactgtgggaaagccttccttacaaagacaatgctcattgtacatcacagaactcacacgggagagagaccctatggctgtgatgagtgttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatag

SEQ ID NO: 203064 - DNA, 573 bp, Homo sapiens
  Payload ID: 20042
  Gene Name: zinc finger protein 577
  ENST ID: ENST00000446514
  CDS Start-End: 399-573
gtttagagacttcgggtccctgactcgcctccagcagtggagacaggtcatcggtctgttgagcatttttgtcatctgcaaataattttagccaggtggcaagtgtatggactgtggagtaagaagtacctgcctctgcctctgacttggaagccctcatcttctctctcctctccaaaggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacc

SEQ ID NO: 203065 - DNA, 444 bp, Homo sapiens
  Payload ID: 20042
  Gene Name: zinc finger protein 577
  ENST ID: ENST00000592321
  CDS Start-End: 266-444
gagtgtcgcgtctgcagtgtgtggggttcgcggggcggcgggtagaggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagt

SEQ ID NO: 203066 - DNA, 453 bp, Homo sapiens
  Payload ID: 20042
  Gene Name: zinc finger protein 577
  ENST ID: ENST00000591320
  CDS Start-End: 410-453
gagtgtcgcgtctgcagtgtgtggggttcgcggggcggcgggtagaggcgagtgtttagagacttcgggtccctgactcgcctccagcagtggagacagttgagcatttttgtcatctgcaaataattttagccaggtggcaagtgtatggactgtggagtaagaagtacctgcctctgcctctgacttgggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaagg

SEQ ID NO: 203067 - DNA, 2017 bp, Homo sapiens
  Payload ID: 20043
  Gene Name: zinc finger protein 578
  Uniprot ID: Q96N58
  ENST ID: ENST00000421239
  CDS Start-End: 245-2017
gatcgcgtggggagccggtcttggagcagcgggattagcttctaaagtctctttcatctctcctaaggaagaagcctagaagaggaggaagaggaaagaaaaggagtcaggaatgcctcttagatatctcttccaaatgcatgatgaaaaaggtgggaagattacttgagccagggagttgaaggctgcagtgagccctgtttttgccaccacactccagcttgggattgatttctaaagactcatgttacatgaggaagcagctcagaagaggaaaggaaaggagccaggcatggctcttcctcagggacgcttgactttcagggatgtggctatagaattctcattggcagagtggaaattcctgaaccctgcgcagagggctttgtacagggaagtgatgttggagaactacaggaacctggaggctgtggatatctcttccaaacgcatgatgaaggaggtcttgtcaacagggcaaggcaatacagaagtgatccacacagggatgttgcaaagacatgaaagttatcacactggagatttttgcttccaggaaattgaaaaagatattcatgactttgagtttcagtcacaaaaagatgaaagaaatggccatgaagcatccatgccaaaaatcaaagagttgatgggtagcacagaccgacatgatcaaaggcatgctggaaacaagcctattaaagatcagcttggattaagctttcatttgcatcttcctgaactccacatatttcagcccgaagagaaaattgctaatcaagtggagaagtctgtcaacgatgcttcctcaatttcaacatcccaaagaatttcttgtaggcctgaaacacatactcctaataactatgggaataattttttccattcatcattactcacacaaaaacaggaagtacacatgagagaaaaatctttccaatgtaatgagactggcgaagcctttaattgtagctcatttgtaaggaaacatcagataatccatttaggagaaaaacaatataaatttgatatatgtggcaaagtctttaatgagaagcgataccttgcacgccatcgtagatgtcacactagtgagaaaccttacaagtgtaatgaatgtggaaagtccttcagttacaagtcatccctgacatgccatcgtagatgtcacactggtgagaaaccttacaagtgtaatgaatgtggaaagtccttcagttacaagtcatcccttacatgccatcataggtgtcacactggtgagaaaccttacaagtgtaatgaatgtggaaagtccttcagttacaagtcatcccttagatgccatcgtagacttcatactggaataaaaccttacaagtgtaatgagtgtggcaagatgtttggtcaaaattcaacccttgtaattcataaggcaattcatactggagagaaaccttacaagtgtaatgaatgtggcaaggcttttaatcaacaatcacacctttcacgtcatcatagacttcatactggagagaaaccttacaagtgtaatgactgtggtaaggcttttattcatcagtcaagccttgcacgtcatcatagacttcatactggagagaaatcttacaaatgtgaagaatgtgacagagttttcagtcagaaatcaaaccttgagagacacaagataattcatactggagagaaaccttacaagtgtaatgagtgtcacaagaccttcagtcacaggtcatctcttccatgccatcgtagacttcatagtggtgagaaaccttacaagtgtaatgaatgtgggaagacttttaatgtacagtcacacctttcacgtcatcatagacttcatactggagagaaaccttacaaatgtaaggtttgtgacaaggctttcatgtgccattcttatctggcaaaccatactagaattcatagcggagagaaaccttacaagtgtaatgagtgtggtaaggctcacaatcacttgattgattcatcaatcaagccttgcatgtcatcatag

SEQ ID NO: 203068 - DNA, 814 bp, Homo sapiens
  Payload ID: 20043
  Gene Name: zinc finger protein 578
  ENST ID: ENST00000601120
  CDS Start-End: 54-814
cgtatcgcttggagtgaaggtcctaccgcggcatgattgatttctaaagactcatgttacatgaggaagcagctcagaagaggaaaggaaaggagccaggcatggctcttcctcagggacgcttgactttcagggatgtggctatagaattctcattggcagagtggaaattcctgaaccctgcgcagagggctttgtacagggaagtgatgttggagaactacaggaacctggaggctgtggatatctcttccaaacgcatgatgaaggaggtcttgtcaacagggcaaggcaatacagaagtgatccacacagggatgttgcaaagacatgaaagttatcacactggagatttttgcttccaggaaattgaaaaagatattcatgactttgagtttcagtcacaaaaagatgaaagaaatggccatgaagcatccatgccaaaaatcaaagagttgatgggtagcacagaccgacatgatcaaaggcatgctggaaacaagcctattaaagatcagcttggattaagctttcatttgcatcttcctgaactccacatatttcagcccgaagagaaaattgctaatcaagtggagaagtctgtcaacgatgcttcctcaatttcaacatcccaaagaatttcttgtaggcctgaaacacatactcctaataactatgggaataattttttccattcatcattactcacacaaaaacaggaagtacacatgagagaaaaatctttccaatgtaatgagactggcgaagcctttaattgtagctcatttgtaaggaaacatcagataatccattt

SEQ ID NO: 203069 - DNA, 2899 bp, Homo sapiens
  Payload ID: 20044
  Gene Name: zinc finger protein 579
  Uniprot ID: Q8NAF0
  ENST ID: ENST00000325421
  CDS Start-End: 30-1718
aaggaagaaaggagccaaggaggcgaggcatggatccgcagcctcctccacccgcccagggcagcccacctcaccgtggccgaggccggggccgtggccgaggccgtggtcggggccgtggccgtggcagggggggcgctggagcccctagggcgcccctgccctgccccacctgcggccgcctcttccgtttcccctactacctctcccggcaccggctgagccactcggggctccggccccacgcctgcccgctgtgccccaaggccttccgccggccggcccacctttcccgccacctgcgcggccacgggccccagcccccgctgcgctgcgccgcctgcccccgcaccttcccagaaccggcccagctcaggcgccacctggctcaggagcacgcgggcggcgaggtcgagctggccatcgagagggtggccaaggagacggccgaacccagctggggcccgcaggacgagggctcggagccgcccaccaccgctgcagcaggggccacggaggaggaggcggtcgcagcgtggcctgagacgtggcctgcgggggagccttccacgctggctgcgcccaccagcgccgcggagccccgggagtcggagtcggaggaggccgaggccggggcagcagagctgagggccgagctggcgctggcggccgggcggcaggaggagaaacaggtcctgctccaggcagactggacgctgctgtgtctgcgctgccgcgaagccttcgccaccaagggcgagctcaaggcgcacccgtgtctgcgccccgagggcgaacaggaaggggaaggggggcccccgccacgccccaagcgacaccagtgctccatctgcctcaaggccttcgccaggccctggtccctgtcgcgccaccggctggtccactccaccgaccgccctttcgtgtgcccagactgcggcctggccttccgcctcgcctcctacctccgccagcaccgccgcgtccacggccccctcagcctgctggccccgctgcccgcggcgggcaagaaggacgacaaggcctcgggtgcacggaactcagccaaggggccggaggggggcgagggggcggagtgcgggggtgcctcggaagggggagaagggcagaacggaggcgacgccgccccggctcggccccccgccggggagccccgcttctggtgcccagagtgcggcaaaggtttcaggcgccgggcgcacctgcggcagcacggggtgacccactcgggagcgcgccccttccagtgcgtgcgctgccagcgggagttcaagcgcctggccgacctggcgcgccacgcacaggtgcacgcggggggcccagccccgcacccgtgcccccgctgcccgcgccgcttctcgcgcgcctacagcctcctgcgccaccagcgctgccaccgcgcagagctggagagggccgccgcgctgcaggcactgcaggcccaggccccgacgtcgccgccaccgcccccgccgcccctgaaggccgagcaggaggaagaagggctcccgctgcccctcgcaaacattaaggaagagccgccctctccggggaccccaccccagtccccgccggctccccctgtcttcctcagcgcctcctgtttcgacagccaagaccactcagccttcgagatggaggaggaagaggtagacagcaaggctcacctgcgcgggctggggggcctggcctcctgaccttcgccgccctgccctccgccgctccgcctgagctccccggtttgcagaatggaggagggaagttgaaggagccacctcctctgtctacccacccgtccccttcacgcccttgacactaaggagtggggggccctggactgccccttcctcccccatcgcccgcccccagaacccctgatgctggttaggaaccgctcaccccaacatgtgtcttaaggcaggacgacttggaaaaaaaggcggcggacagttggccagagggatggagactggtggggacgcccccgcctccctgtcccccgtttcacacactggacaccatcacctctttggaactgccagaccctgggggtccccagtgagcaaaggtctgtccttgtccctttgtctgtctgtgaataaatgtgagttcgtgaaatccaagagagcgaggtgttctgtggaggtggggcaggctgggggcgctggggcgagtcaggatttgtccagccaactctgaacttgggttcagagcaggaaggacacagatgcatcagaaaatatgtggccctcaaccaagcaagaagccggtgaaggctgggttgagaagaaacaggaatgtgagaagatagatcatcgtcaccgctgccctgtggaagctccgcgcgattatcctcaccactgccctgtggaagctccgcgccttactcagtcaatctctaccacacccttactctgtgtcagcggtggtactaggcactgaggaggagtccaataccttcctctgaaagagctggaattctagccctgcattgtccaacataactttttttttttctcagaaaagtttccataatctttcttccctcactctgttgcccaagctgcagtgccgtggtgcagtcatagctcactgcagtctcaaactcccagacccaagcaatcctcttagcctctcaaggagctaggactacaggtgcatgccaccacacccagctgattgtttcatttcttgcagagacggagtcttgctatcttgcccagtctgggagaactttttgtgatgatgggatattctacatcttcactgtccaatatgatatccagcagacacacgtggctatttccgtttaaatttagaatatggaaatgtaaagacattaagatgaaataaatgtaaaagttcggttcctcagtca

SEQ ID NO: 203070 - DNA, 497 bp, Homo sapiens
  Payload ID: 20044
  Gene Name: zinc finger protein 579
  ENST ID: ENST00000592239
  CDS Start-End: 452-497
gtccgcgtttggccggccgtggggaaggaagaaaggagccaaggaggcgagtctctttgtttcctcttctctgtgtctctgtctctctgctgggtgttcctcactctcctctgtctcttctctgctctgcctttcaccatcctgtctttctgcgactcctggtctctgtctgtccatccccacttctctgtgtctcccatctctgccttctcctgtctctattccctgctctgtcgctctgtctctgatctctctcctcctgtctctccatctctggcctcccctcggtgtctctcatctttgtctctgtctcatatctctctcctggctaaatacctgaccctctctgcctctccatctctgactgtctctgcttctctttctgccacaccccacgcacctctttttatctctgccccgcttcccatctctcccctctctccccacaggcatggatccgcagcctcctccacccgcccagggcagcccacctcacc

SEQ ID NO: 203071 - DNA, 1261 bp, Homo sapiens
  Payload ID: 20045
  Gene Name: zinc finger protein 580
  Uniprot ID: Q9UK33
  ENST ID: ENST00000325333
  CDS Start-End: 301-819
acgcctccggtcccctccccgcagggcgctccgcagaggcgaggggtgggagcgccggctccaggcggcggaacctccgcactgggctcgcgcgcttccggccggcgccttttcccagggactccgccaacccctcgcacccccgcgcccccagtccccgcgtccccggcgccgccggcccggagctgcccggaagtctcggttccgccgccggcgctcgccaggggaagcccggggccgcccgggacctcggcccgttcctccggacccgagaggccgccgcacgggctgccgctccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagtttccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactcc

SEQ ID NO: 203072 - DNA, 1707 bp, Homo sapiens
  Payload ID: 20045
  Gene Name: zinc finger protein 580
  Uniprot ID: Q9UK33
  ENST ID: ENST00000543039
  CDS Start-End: 747-1265
ggaaggcatttgagccattttggggtgtatagatgtagtaagacgatgggttccgtagtggggagaggtgactagacttcgaggtgctaagtgtaggaacaggatggaaaagccctagtgaaatgtggggaattgggttagtggggctctggggaggtacctagagaggaagtgagggaggccacggaatatgaagatggggaggccctgcggcatgtagtggggacggagggccaggaggccgatacgggggccggtgggggggtagggggcggcaaagggaggggaagtaaactgaactggggctgggcaacaggaaaaaagaagaaaccacagattagagaaatctcggcggtcaggaggcccggggtctaagatgtaaagaggtaaacagatttagggattgattgtctgctggggtgggttgagaggagaaaagggaagaaaagtcgggggactacgtcctcagacctgacctgagtggtgagaggtggacccaggaggagtggcaggtggtggcggggttttgcagagctcagttggaggccctctccgaggcagcttgatggaacgtgggagagccgggctggagtcacagtttttattttgctagggaggtagtcagtggcgcacaaagggtaacaagcagtgatagtggggatgctttccattttaggaaacttttcctaaaaggaagtggcaattttaactaatctcccctccgccgctcccagctgccgctccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagtttccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactcc

SEQ ID NO: 203073 - DNA, 1025 bp, Homo sapiens
  Payload ID: 20045
  Gene Name: zinc finger protein 580
  Uniprot ID: Q9UK33
  ENST ID: ENST00000545125
  CDS Start-End: 65-583
agattagagaaatctcggcggtcaggaggcccggggtctaagatgtaaagagctgccgctccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagtttccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactcc

SEQ ID NO: 203074 - DNA, 335 bp, Homo sapiens
  Payload ID: 20045
  Gene Name: zinc finger protein 580
  ENST ID: ENST00000590190
  CDS Start-End: 270-335
gcgcgcttccggccggcgccttttcccagggactccgccaacccctcgcacccccgcgcccccagtccccgcgtccccggcgccgccggcccggagctgcccggaagtctcggttccgccgccggcgctcgccaggggaagcccggggccgcccgggacctcggcccgttcctccggacccgagaggccgccgcacggggaaacttttcctaaaaggaagtggcaattttaactaatctcccctccgccgctcccagctgccgctccagatgctgctgctgccgccgcggccaccccaccctcggtcctcctctccggaggccatggacccaccg

SEQ ID NO: 203075 - DNA, 377 bp, Homo sapiens
  Payload ID: 20045
  Gene Name: zinc finger protein 580
  ENST ID: ENST00000592461
  CDS Start-End: 65-377
agattagagaaatctcggcggtcaggaggcccggggtctaagatgtaaagagctgccgctccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctc

SEQ ID NO: 203076 - DNA, 1019 bp, Homo sapiens
  Payload ID: 20045
  Gene Name: zinc finger protein 580
  ENST ID: ENST00000592881
  CDS Start-End: 710-1019
ccggacgtgaaagtttgctgcgtagggatagggagaccgggccggattgcggggagtgagcaggttcagcagtgacggcattcttaagagtcctgcccaagtgagggacttggggtgtgggacagagtggcccccagggcagtgggcgttggaaactgagaggccctgcgaaggaggcttggggaggggctacggtgaccaggggacgaggtataggaagaggagggcggaaagccttgagggtgggcttcttggatcccaattgccccagaggcacaggcctgggcatcactgtattatttcccgaggggagaaggggctatttcccatgggaagacaaagtgggatgaatagtggaccttgagaagagggggtggccaggaaaaggttcctgaaggaggcaggacccagactgcaggctggggagggtttgggcagccagagggaggtgagggtgctggagcgggggtcaatcggtcactccggccggagatctgagtggcctctgccccctctgcgctgtggagtgcatctgattgccagcctcgctggaccgttgagaggattcatcgagaccctggatatgaatatgcagtgtgaactgaagtttggggacatgagtaatcagtcacagtggcccaagatttgaggtgtaaatggagaagtcagaatgattcgctgcagctgtctggaacagctgccgctccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagcc

SEQ ID NO: 203077 - DNA, 1298 bp, Homo sapiens
  Payload ID: 20046
  Gene Name: zinc finger protein 581
  Uniprot ID: Q9P0T4
  ENST ID: ENST00000270451
  CDS Start-End: 248-841
tttcctctcggtgtgtgtttctggccggagccgtttcgcgacggcccgggcgccccgccccaaccttccttccctagaccctcttctctcccttcggcttctctctttcggccggcgccgccagttcctggggcacacccagaggtccccttctcgccgccgcctgcaactgcgagggtagcccggggccgcttggagtcgcccggacctgagaggctgctgcactgggcctcagccagccctccggatgctggtgctgccatccccctgccctcagcctctggcattttcctccgttgagaccatggagggccctccccgtcggacttgccgctccccagaacctggaccttcctcctccatcggatctccccaggcttcatctcctccaaggcccaaccactacctgcttattgacactcagggtgtcccctacacagtgctggtggacgaggagtcacagagggagccaggggccagtggggctccaggccagaaaaagtgctacagctgccccgtgtgctcaagggtcttcgagtacatgtcctaccttcagcgacacagcatcacccactcggaggtaaagcccttcgagtgtgacatctgtgggaaggcattcaagcgcgccagccacttggcacggcaccattccattcacctggcgggtggtgggcggccccacggctgcccgctctgccctcgccgcttccgggatgcgggtgagctggcccagcacagccgggtgcactctggggaacgcccgtttcagtgtccacactgccctcgccgctttatggagcagaacacactgcagaaacacacgcggtggaagcatccatgagccgggctgccgggtgccccaggtaccacaggactttgcagggagcctggactcctgtccagacacctggtgagagcctgaggctggtgttcagggccctggacacagacacagagcagccgcatctcaaaggcagagccctgcctgaaggaggaatccgtgagtaatcttcaggtcctccgtgttctggagctgagatgggaatgagcccctacacagaatggagtcctctagcctaaagatatcagctgttccatggcagagccttgactggatggaggtggggagtgtggtgtgtaaagtctctggcctcataaaaggtggctgtgggtcgtcaggaatctgcgccatcttcctggggcttctgcgctgttgttggggaagggaccccagtcctgccttccaccccccaaccaggcctgagactgatcaaacaataaacacgtttcccactctg

SEQ ID NO: 203078 - DNA, 1324 bp, Homo sapiens
  Payload ID: 20046
  Gene Name: zinc finger protein 581
  Uniprot ID: Q9P0T4
  ENST ID: ENST00000587252
  CDS Start-End: 274-867
gggaggtgagggtgctggagcgggggtcaatcggtcactccggccggagatctgagtggcctctgccccctctgcgctgtggagtgcatctgattgccagcctcgctggaccgttgagaggattcatcgagaccctggatatgaatatgcagtgtgaactgaagtttggggacatgagtaatcagtcacagtggcccaagatttgaggtgtaaatggagaagtcagaatgattcgctgcagctgtctggaacaggcctcagccagccctccggatgctggtgctgccatccccctgccctcagcctctggcattttcctccgttgagaccatggagggccctccccgtcggacttgccgctccccagaacctggaccttcctcctccatcggatctccccaggcttcatctcctccaaggcccaaccactacctgcttattgacactcagggtgtcccctacacagtgctggtggacgaggagtcacagagggagccaggggccagtggggctccaggccagaaaaagtgctacagctgccccgtgtgctcaagggtcttcgagtacatgtcctaccttcagcgacacagcatcacccactcggaggtaaagcccttcgagtgtgacatctgtgggaaggcattcaagcgcgccagccacttggcacggcaccattccattcacctggcgggtggtgggcggccccacggctgcccgctctgccctcgccgcttccgggatgcgggtgagctggcccagcacagccgggtgcactctggggaacgcccgtttcagtgtccacactgccctcgccgctttatggagcagaacacactgcagaaacacacgcggtggaagcatccatgagccgggctgccgggtgccccaggtaccacaggactttgcagggagcctggactcctgtccagacacctggtgagagcctgaggctggtgttcagggccctggacacagacacagagcagccgcatctcaaaggcagagccctgcctgaaggaggaatccgtgagtaatcttcaggtcctccgtgttctggagctgagatgggaatgagcccctacacagaatggagtcctctagcctaaagatatcagctgttccatggcagagccttgactggatggaggtggggagtgtggtgtgtaaagtctctggcctcataaaaggtggctgtgggtcgtcaggaatctgcgccatcttcctggggcttctgcgctgttgttggggaagggaccccagtcctgccttccaccccccaaccaggcctgagactgatcaaacaataaacacgtttcccactctg

SEQ ID NO: 203079 - DNA, 591 bp, Homo sapiens
  Payload ID: 20046
  Gene Name: zinc finger protein 581
  ENST ID: ENST00000585995
  CDS Start-End: 173-591
cgcacccccgcgcccccagtccccgcgtccccggcgccgccggcccggagctgcccggaagtctcggttccgccgccggcgctcgccaggggaagcccggggccgcccgggacctcggcccgttcctccggacccgagaggccgccgcacggggcctcagccagccctccggatgctggtgctgccatccccctgccctcagcctctggcattttcctccgttgagaccatggagggccctccccgtcggacttgccgctccccagaacctggaccttcctcctccatcggatctccccaggcttcatctcctccaaggcccaaccactacctgcttattgacactcagggtgtcccctacacagtgctggtggacgaggagtcacagagggagccaggggccagtggggctccaggccagaaaaagtgctacagctgccccgtgtgctcaagggtcttcgagtacatgtcctaccttcagcgacacagcatcacccactcggaggtaaagcccttcgagtgtgacatctgtgggaaggcattcaagcgcgccagccacttggcacggcaccattccattcacctggcggg

SEQ ID NO: 203080 - DNA, 1100 bp, Homo sapiens
  Payload ID: 20046
  Gene Name: zinc finger protein 581
  Uniprot ID: Q9P0T4
  ENST ID: ENST00000588537
  CDS Start-End: 51-644
gggcggcgggaggggctggaccgcgtggagggcctcagccagccctccggatgctggtgctgccatccccctgccctcagcctctggcattttcctccgttgagaccatggagggccctccccgtcggacttgccgctccccagaacctggaccttcctcctccatcggatctccccaggcttcatctcctccaaggcccaaccactacctgcttattgacactcagggtgtcccctacacagtgctggtggacgaggagtcacagagggagccaggggccagtggggctccaggccagaaaaagtgctacagctgccccgtgtgctcaagggtcttcgagtacatgtcctaccttcagcgacacagcatcacccactcggaggtaaagcccttcgagtgtgacatctgtgggaaggcattcaagcgcgccagccacttggcacggcaccattccattcacctggcgggtggtgggcggccccacggctgcccgctctgccctcgccgcttccgggatgcgggtgagctggcccagcacagccgggtgcactctggggaacgcccgtttcagtgtccacactgccctcgccgctttatggagcagaacacactgcagaaacacacgcggtggaagcatccatgagccgggctgccgggtgccccaggtaccacaggactttgcagggagcctggactcctgtccagacacctggtgagagcctgaggctggtgttcagggccctggacacagacacagagcagccgcatctcaaaggcagagccctgcctgaaggaggaatccgtgagtaatcttcaggtcctccgtgttctggagctgagatgggaatgagcccctacacagaatggagtcctctagcctaaagatatcagctgttccatggcagagccttgactggatggaggtggggagtgtggtgtgtaaagtctctggcctcataaaaggtggctgtgggtcgtcaggaatctgcgccatcttcctggggcttctgcgctgttgttggggaagggaccccagtcctgccttccaccccccaaccaggcctgagactgatcaaacaataaacacgtttcccactct

SEQ ID NO: 203081 - DNA, 2824 bp, Homo sapiens
  Payload ID: 20047
  Gene Name: zinc finger protein 582
  Uniprot ID: Q96NG8
  ENST ID: ENST00000301310
  CDS Start-End: 160-1713
caccggtaccgtggtggaagcgcgccctgggctgccgggggcgcggccgcggtggcacttggacccgaggaggcggcagctctaccgtcgcaggactctgcccttccccaagagaggaaccagaaggaggacctatcagcccttgaaattctaaaagtcatgtcccttgggtcagaattgttcagggatgtggccatagtcttctcccaagaagaatggcagtggttggcacctgctcagagggatttgtacagagacgtgatgttggagacctacagcaacctggtctcactgggtcttgccgtttccaaacctgatgtgatctccttcctagagcaaggcaaagagccctggatggtggagagagtggtgtctggaggcctgtgtccagtattggagtccagatatgataccaaggaattatttccaaagcagcatgtttatgaagtcgaatcaccccaatgggagataatggaaagccttacaagttatggtcttgagtgttcaagtttccaagatgattgggaatgcagaaaccagtttgacagacaacagggaaatccagacagacatttccatcagatgatcatcagacatgaagaaatgcccacttttgaccagcatgcatcccttactttttatcagaaaattcatactagagaaaaaccttttgggtataataaatgtagaaaagacttctggcaaaaggaactccttattaatcatcaaggaatttatactaatgagaaaccctataaatgtaaggaatgtgggaaggcctttaaatatggctcacgactaattcaacatgagaatattcattctggtaagaaaccatatgaatgtaaggaatgtggaaaggccttcaattctggttcaaattttatacaacatcagagagttcatactggtgagaaaccgtatgaatgtaaagattgtgagaaggcctttagtcgaagctcacagttgattgaacatcagcgaactcacacaggcgagaaaccctatcagtgtaaggaatgtggcaaggccttcaatcggatctcacatcttaaagtacattatagaattcatactggtgaaaaaccctatgcatgcaaggaatgtgggaaaacctttagtcatcgttctcagttgattcaacatcagactgttcatactggcaggaaactctatgaatgtaaggaatgtgggaaggcttttaatcaaggctcaactcttatacgacatcagagaattcataccggtgagaaaccctatgagtgcaaagtatgtggaaaggcctttagagtgagctcacaactcaagcaacatcagagaattcacactggagagaaaccctaccaatgtaaggtatgtggtagggccttcaaacgggtctcacatcttactgtacattacagaattcatacaggtgaaaagccatatgaatgtaaggaatgtgggaaggcttttagtcattgctcacaattgattcatcatcaggttattcacactgagaaaaagccctatgaatataaggaatgtgagaagaccttgagtcatgattcaactaccgttcaacctcagagaatgcataatagagaaacacatgtgaatataataaatgtagaaaagccttccatcagcagttaccccttactaatcatcagagaatttatgttggcaagcaaccatatgaatggaagtaatggggaaagcccattagcctaggctaattgtgactgtgacttacttctccctcttggagaaagacttgaagaatgtaatgccagtgacaatgccttcattcagaggtaagcctttatcctaagtctgaaaattcatatcaaagaaaattttatggatgtaaattgttcagatcataattgtcaaaaatgctgggaaaggttgggagaaattttatttctaacacattccagaaccacattttctaaccacagtgtagtaattttatcaagagcaaaagttatagttttcttacaagttaaaaaaacagccagattatcatttgcttaacaaagaaatcatgcaattaccataaatggtaatgaaaagaatgaattgagagtttaacatgccaagagatgtgaaatgtggccaaagagatgtgagggtaaggggaaagccaaagctacactggaggaatttttatagcctttgaatgcatgcatatacatgaaaatctgaaagataaactcatatgcactaaacatgctattcaagtctaccaaacatccaggcagtgaaagaagaaagtaacagaaaatgatgaaataaagagaccatcttacaataatctcagtttttgtttctttctgatccagaaataatctaaatttaggagaatatttcttaatttccacattgttacattgttttatgtgactggcacagacaaccattggttgtcatcccagcagccatacccaattccccttgttattggcagcatctgtgtcttgccttggactctgagaatatcagatgctaattttccagtctcctgtgcagcacagtatggccagtatctcccagtgttgctcagtggaatctgccggggcttctgggaaagattttcctcattcagaagagacaggtttatcatgaagacttcctcctctctcacttcctgcttttaaacatttttatataagaacatgatgcctgaagctgctgcagctgtcttggaaccaagaagagaaaaaagtggacctcagagaagctgacccagagcctgagaagactcagctactaggccaattctggaactgcctttttgatgccttgttatctgagaaaaataaaacttgattgctcagtt

SEQ ID NO: 203082 - DNA, 2053 bp, Homo sapiens
  Payload ID: 20047
  Gene Name: zinc finger protein 582
  Uniprot ID: Q96NG8
  ENST ID: ENST00000586929
  CDS Start-End: 407-1960
atcttccggctgcgcacggcgaatccaccggtaccgtggtggaagcgcgccctgggctgccgggggcgcggccgcggtggcacttggacccgaggaggcggcaggtgagaggttccggagctttccaggcgctctggggtccagcaggagctggtgcccgggccggttgggtctcaggcctgagaagaacgcagacgtctcgcctcatcgtcgctctgtggctttaccggcgtgagactacatttcccgccggccctcgcggcgtgcgctttctggcgccccctttctgcttccagcctcatagcccaggtgcatggaccccttagctctaccgtcgcaggactctgcccttccccaagagaggaaccagaaggaggacctatcagcccttgaaattctaaaagtcatgtcccttgggtcagaattgttcagggatgtggccatagtcttctcccaagaagaatggcagtggttggcacctgctcagagggatttgtacagagacgtgatgttggagacctacagcaacctggtctcactgggtcttgccgtttccaaacctgatgtgatctccttcctagagcaaggcaaagagccctggatggtggagagagtggtgtctggaggcctgtgtccagtattggagtccagatatgataccaaggaattatttccaaagcagcatgtttatgaagtcgaatcaccccaatgggagataatggaaagccttacaagttatggtcttgagtgttcaagtttccaagatgattgggaatgcagaaaccagtttgacagacaacagggaaatccagacagacatttccatcagatgatcatcagacatgaagaaatgcccacttttgaccagcatgcatcccttactttttatcagaaaattcatactagagaaaaaccttttgggtataataaatgtagaaaagacttctggcaaaaggaactccttattaatcatcaaggaatttatactaatgagaaaccctataaatgtaaggaatgtgggaaggcctttaaatatggctcacgactaattcaacatgagaatattcattctggtaagaaaccatatgaatgtaaggaatgtggaaaggccttcaattctggttcaaattttatacaacatcagagagttcatactggtgagaaaccgtatgaatgtaaagattgtgagaaggcctttagtcgaagctcacagttgattgaacatcagcgaactcacacaggcgagaaaccctatcagtgtaaggaatgtggcaaggccttcaatcggatctcacatcttaaagtacattatagaattcatactggtgaaaaaccctatgcatgcaaggaatgtgggaaaacctttagtcatcgttctcagttgattcaacatcagactgttcatactggcaggaaactctatgaatgtaaggaatgtgggaaggcttttaatcaaggctcaactcttatacgacatcagagaattcataccggtgagaaaccctatgagtgcaaagtatgtggaaaggcctttagagtgagctcacaactcaagcaacatcagagaattcacactggagagaaaccctaccaatgtaaggtatgtggtagggccttcaaacgggtctcacatcttactgtacattacagaattcatacaggtgaaaagccatatgaatgtaaggaatgtgggaaggcttttagtcattgctcacaattgattcatcatcaggttattcacactgagaaaaagccctatgaatataaggaatgtgagaagaccttgagtcatgattcaactaccgttcaacctcagagaatgcataatagagaaacacatgtgaatataataaatgtagaaaagccttccatcagcagttaccccttactaatcatcagagaatttatgttggcaagcaaccatatgaatggaagtaatggggaaagcccattagcctaggctaattgtgactgtgacttacttctccctcttggagaaagacttgaagaatgtaatgccagtgacaatgccttcattcagaggtaagccttt

SEQ ID NO: 203083 - DNA, 509 bp, Homo sapiens
  Payload ID: 20047
  Gene Name: zinc finger protein 582
  ENST ID: ENST00000589895
  CDS Start-End: 275-509
cggagctttccaggcgctctggggtccagcaggagctggtgcccgggccggttgggtctcaggcctgagaagaacgcagacgtctcgcctcatcgtcgctctgtggctttaccggcgtgagactacatttcccgccggccctcgcggcgtgcgctttctggcgccccctttctgcttccagcctcatagcccagctctaccgtcgcaggactctgcccttccccaagagaggaaccagaaggaggacctatcagcccttgaaattctaaaagtcatgtcccttgggtcagaattgttcagggatgtggccatagtcttctcccaagaagaatggcagtggttggcacctgctcagagggatttgtacagagacgtgatgttggagacctacagcaacctggtctcactgggtcttgccgtttccaaacctgatgtgatctccttcctagagcaaggcaaagagccctggatggtggagagagtggtgtctggaggcctgtgtccaggtg

SEQ ID NO: 203084 - DNA, 712 bp, Homo sapiens
  Payload ID: 20047
  Gene Name: zinc finger protein 582
  ENST ID: ENST00000593145
  CDS Start-End: 178-712
ggctgcgcacggcgaatccaccggtaccgtggtggaagcgcgccctgggctgccgggggcgcggccgcggtggcacttggacccgaggaggcggcagctctaccgtcgcaggactctgcccttccccaagagaggaaccagaaggaggacctatcagcccttgaaattctaaaagtcatgtcccttgggtcagaattgttcagggatgtggccatagtcttctcccaagaagaatggcagtggttggcacctgctcagagggatttgtacagagacgtgatgttggagacctacagcaacctggtctcactgggtcttgccgtttccaaacctgatgtgatctccttcctagagcaaggcaaagagccctggatggtggagagagtggtgtctggaggcctgtgtccagtattggagtccagatatgataccaaggaattatttccaaagcagcatgtttatgaagtcgaatcaccccaatgggagataatggaaagccttacaagttatggtcttgagtgttcaagtttccaagatgattgggaatgcagaaaccagtttgacagacaacagggaaatccagacagacatttccatcagatgatcatcagacatgaagaaatgcccacttttgaccagcatgcatcccttactttttatcagaaaattcatactagagaaaaaccttttgggtataataaatgtagaaaag

SEQ ID NO: 203085 - DNA, 733 bp, Homo sapiens
  Payload ID: 20047
  Gene Name: zinc finger protein 582
  ENST ID: ENST00000587778
  CDS Start-End: 190-733
gtggctttaccggcgtgagactacatttcccgccggccctcgcggcgtgcgctttctggcgccccctttctgcttccagcctcatagcccaggtgcatggaccccttagctctaccgtcgcaggactctgcccttccccaagagaggaaccagaaggaggacctatcagcccttgaaattctaaaagtcatgtcccttgggtcagaattgttcagggatgtggccatagtcttctcccaagaagaatggcagtggttggcacctgctcagagggatttgtacagagacgtgatgttggagacctacagcaacctggtctcactgggtcttgccgtttccaaacctgatgtgatctccttcctagagcaaggcaaagagccctggatggtggagagagtggtgtctggaggcctgtgtccagtattggagtccagatatgataccaaggaattatttccaaagcagcatgtttatgaagtcgaatcaccccaatgggagataatggaaagccttacaagttatggtcttgagtgttcaagtttccaagatgattgggaatgcagaaaccagtttgacagacaacagggaaatccagacagacatttccatcagatgatcatcagacatgaagaaatgcccacttttgaccagcatgcatcccttactttttatcagaaaattcatactagagaaaaaccttttgggtataataaatgtagaaaagacttctggc

SEQ ID NO: 203086 - DNA, 625 bp, Homo sapiens
  Payload ID: 20047
  Gene Name: zinc finger protein 582
  ENST ID: ENST00000589143
  CDS Start-End: 118-427
gcggccgcggtggcacttggacccgaggaggcggcagctctaccgtcgcaggactctgcccttccccaagagaggaaccagaaggaggacctatcagcccttgaaattctaaaagtcatgtcccttgggtcagaattgttcagggatgtggccatagtcttctcccaagaagaatggcagtggttggcacctgctcagagggatttgtacagagacgtgatgttggagacctacagcaacctggtctcactgggtcttgccgtttccaaacctgatgtgatctccttcctagagcaaggcaaagagccctggatggtggagagagtggtgtctggaggcctgtgtccaggagctaaagggcagaggggcagagatgctggctgtgcttgctgtaaaagaacagaacagaaccccggtcaattatggaaaatgactgagtctggcctgtttttcatgcactaaacatgtgggaatcccactgttttttccagattatactgtgtatgtagacagtggagagggctaacctcattaagggtgcaagaggggctggttttacagggggcctctactacgaaggcctaatggttttgaaaatgaactcaaataaaagattattaccaaa

SEQ ID NO: 203087 - DNA, 2297 bp, Homo sapiens
  Payload ID: 20047
  Gene Name: zinc finger protein 582
  Uniprot ID: Q96NG8
  ENST ID: ENST00000619584
  CDS Start-End: 160-1713
caccggtaccgtggtggaagcgcgccctgggctgccgggggcgcggccgcggtggcacttggacccgaggaggcggcagctctaccgtcgcaggactctgcccttccccaagagaggaaccagaaggaggacctatcagcccttgaaattctaaaagtcatgtcccttgggtcagaattgttcagggatgtggccatagtcttctcccaagaagaatggcagtggttggcacctgctcagagggatttgtacagagacgtgatgttggagacctacagcaacctggtctcactgggtcttgccgtttccaaacctgatgtgatctccttcctagagcaaggcaaagagccctggatggtggagagagtggtgtctggaggcctgtgtccagtattggagtccagatatgataccaaggaattatttccaaagcagcatgtttatgaagtcgaatcaccccaatgggagataatggaaagccttacaagttatggtcttgagtgttcaagtttccaagatgattgggaatgcagaaaccagtttgacagacaacagggaaatccagacagacatttccatcagatgatcatcagacatgaagaaatgcccacttttgaccagcatgcatcccttactttttatcagaaaattcatactagagaaaaaccttttgggtataataaatgtagaaaagacttctggcaaaaggaactccttattaatcatcaaggaatttatactaatgagaaaccctataaatgtaaggaatgtgggaaggcctttaaatatggctcacgactaattcaacatgagaatattcattctggtaagaaaccatatgaatgtaaggaatgtggaaaggccttcaattctggttcaaattttatacaacatcagagagttcatactggtgagaaaccgtatgaatgtaaagattgtgagaaggcctttagtcgaagctcacagttgattgaacatcagcgaactcacacaggcgagaaaccctatcagtgtaaggaatgtggcaaggccttcaatcggatctcacatcttaaagtacattatagaattcatactggtgaaaaaccctatgcatgcaaggaatgtgggaaaacctttagtcatcgttctcagttgattcaacatcagactgttcatactggcaggaaactctatgaatgtaaggaatgtgggaaggcttttaatcaaggctcaactcttatacgacatcagagaattcataccggtgagaaaccctatgagtgcaaagtatgtggaaaggcctttagagtgagctcacaactcaagcaacatcagagaattcacactggagagaaaccctaccaatgtaaggtatgtggtagggccttcaaacgggtctcacatcttactgtacattacagaattcatacaggtgaaaagccatatgaatgtaaggaatgtgggaaggcttttagtcattgctcacaattgattcatcatcaggttattcacactgagaaaaagccctatgaatataaggaatgtgagaagaccttgagtcatgattcaactaccgttcaacctcagagaatgcataatagagaaacacatgtgaatataataaatgtagaaaagccttccatcagcagttaccccttactaatcatcagagaatttatgttggcaagcaaccatatgaatggaagtaatggggaaagcccattagcctaggctaattgtgactgtgacttacttctccctcttggagaaagacttgaagaatgtaatgccagtgacaatgccttcattcagaggtaagcctttatcctaagtctgaaaattcatatcaaagaaaattttatggatgtaaattgttcagatcataattgtcaaaaatgctgggaaaggttgggagaaattttatttctaacacattccagaaccacattttctaaccacagtgtagtaattttatcaagagcaaaagttatagttttcttacaagttaaaaaaacagccagattatcatttgcttaacaaagaaatcatgcaattaccataaatggtaatgaaaagaatgaattgagagtttaacatgccaagagatgtgaaatgtggccaaagagatgtgagggtaaggggaaagccaaagctacactggaggaatttttatagcctttgaatgcatgcatatacatgaaaatctgaaagataaactcatatgcactaaacatgctattcaagtctaccaaacatccaggcagtgaaagaagaaagtaacagaaaatgatgaaataaagagaccatcttacaat

SEQ ID NO: 203088 - DNA, 2538 bp, Homo sapiens
  Payload ID: 20048
  Gene Name: zinc finger protein 583
  Uniprot ID: Q96ND8
  ENST ID: ENST00000291598
  CDS Start-End: 166-1875
actgcgcgtgcgcctcaccgcgctggcaccccggcctggcagcctttggggacctgaaccagctgcgcctgcgcagctcgactttctcaggatactgtccctctcccacagaggagctgaaggagtaggacagaagaactgtcaaattctggaatccttaaagccatgtccaaggatttggtgacatttggggatgtggctgtaaatttctctcaagaggaatgggaatggctgaaccctgctcagaggaatttgtacaggaaagtgatgttggagaactacaggagcttggtatcattgggagtttctgtttctaagccagatgtgatctcattattggagcaaggaaaagagccctggatggtgaagaaggagggaacaagaggcccatgccctgattgggagtatgtatttaaaaacagtgaattttcatcaaagcaagagacatatgaagaatcatccaaagttgtgacagtgggagcaagacatcttagttatagccttgactatcccagtttgagagaagactgtcaaagtgaggactggtataagaaccagctgggaagtcaagaggtacatcttagtcaattaatcatcactcataaagaaatccttccagaagttcaaaataaagaatataacaaatcttggcaaacattccaccaggatacaatctttgatatacaacagagttttcccaccaaagaaaaagcacataagcatgaaccacaaaagaaaagttaccgaaaaaaatctgttgaaatgaaacataggaaagtctatgtagaaaagaaacttttgaaatgtaatgattgtgagaaagtcttcaaccagagctcatcccttactcttcatcagagaattcatactggagagaaaccctatgcatgtgttgaatgtgggaaaacgttcagccagagtgcaaacttggcgcaacataagagaatacatactggagagaaaccctatgaatgtaaagaatgtaggaaagccttcagccagaatgcacacctggcccaacatcagagagttcatactggagagaaaccttatcagtgtaaagaatgtaaaaaagccttcagccagattgcacacctgactcagcatcagagagttcatactggagagagacctttcgaatgtattgaatgtggaaaggcctttagtaatggttcatttcttgctcagcatcagagaattcatacaggagagaaaccttatgtgtgtaatgtgtgtgggaaagcctttagccatcgtggatacctaattgtacatcagagaattcatactggagagagaccctacgaatgtaaggaatgtaggaaagccttcagccagtatgcacaccttgctcaacatcagagagttcatactggagaaaaaccttatgaatgtaaagtatgtaggaaagccttcagccaaattgcataccttgatcaacatcagagggttcatactggagagaaaccctatgaatgtattgaatgtgggaaggcctttagcaatagttcatcacttgcacaacatcagagaagtcatactggagaaaaaccctatatgtgtaaggaatgtaggaaaacatttagccagaatgcaggccttgctcaacatcagagaattcatactggagagaaaccttatgaatgtaatgtttgtgggaaagcatttagctatagtggatctcttactctacatcagagaattcatactggagaaagaccctatgaatgtaaagattgcaggaaatctttcaggcagcgtgcacatcttgctcatcatgagagaattcatactatggagtcattcttgactctttcctctccctcaccctccacatcaaatcagttgccaagacctgtaggtttcatctcctgaatatttctggaatccacctcttgaatccatttccatcccatcatccttgtccaatgcacattaatatatttgacatgggatactcgagtagctttctaattggtctccttgtactcaccattgtctctgtcagatgtccacattgcaaccaaatttgtatttttaaaaatatgtttaatctcatttctccctcattaaaatccctcagtggcatcccatggtttttaagttaaagcacacattcttcaaaatagcctaaaaacctagcctctaacaccttgttccaggttaccttccaaagtttctatcttgtgtcactatccatctcattctctgaatacttatccaggattaagatacatattccaggatcaaaaagacctgggttccaatctttgcacttccatttcctgccctctaatttgggggcagcagtttgtgctttgtaagcttcagtcttatttatagtgtgggaataataatggttctacctcagaagttaatagaagaatgaaataatgcatgtaaattgctcagcagcgtgcctagcataaagtaattactcaaaccataatgtaaagtaaaaagataaccatactatacatagaaagccaatcatctcagccatgattatctcagaaataaaaagagatgcagcagctc

SEQ ID NO: 203089 - DNA, 582 bp, Homo sapiens
  Payload ID: 20048
  Gene Name: zinc finger protein 583
  ENST ID: ENST00000391778
  CDS Start-End: 171-582
gtgagcgcggccgccggccaggatcgagccctggcccgggccctggcccagccccggcctccaaggaccgcgccgaaggagctcgactttctcaggatactgtccctctcccacagaggagctgaaggagtaggacagaagaactgtcaaattctggaatccttaaagccatgtccaaggatttggtgacatttggggatgtggctgtaaatttctctcaagaggaatgggaatggctgaaccctgctcagaggaatttgtacaggaaagtgatgttggagaactacaggagcttggtatcattgggagtttctgtttctaagccagatgtgatctcattattggagcaaggaaaagagccctggatggtgaagaaggagggaacaagaggcccatgccctgattgggagtatgtatttaaaaacagtgaattttcatcaaagcaagagacatatgaagaatcatccaaagttgtgacagtgggagcaagacatcttagttatagccttgactatcccagtttgagagaagactgtcaaagtgaggactggtataagaaccagctgggaagtcaagaggtac

SEQ ID NO: 203090 - DNA, 4916 bp, Homo sapiens
  Payload ID: 20048
  Gene Name: zinc finger protein 583
  Uniprot ID: Q96ND8
  ENST ID: ENST00000333201
  CDS Start-End: 211-1920
agggctgcggcgcctttgtgagcgcggccgccggccaggatcgagccctggcccgggccctggcccagccccggcctccaaggaccgcgccgaaggaggtgcccactggagggaggaggcgctcgactttctcaggatactgtccctctcccacagaggagctgaaggagtaggacagaagaactgtcaaattctggaatccttaaagccatgtccaaggatttggtgacatttggggatgtggctgtaaatttctctcaagaggaatgggaatggctgaaccctgctcagaggaatttgtacaggaaagtgatgttggagaactacaggagcttggtatcattgggagtttctgtttctaagccagatgtgatctcattattggagcaaggaaaagagccctggatggtgaagaaggagggaacaagaggcccatgccctgattgggagtatgtatttaaaaacagtgaattttcatcaaagcaagagacatatgaagaatcatccaaagttgtgacagtgggagcaagacatcttagttatagccttgactatcccagtttgagagaagactgtcaaagtgaggactggtataagaaccagctgggaagtcaagaggtacatcttagtcaattaatcatcactcataaagaaatccttccagaagttcaaaataaagaatataacaaatcttggcaaacattccaccaggatacaatctttgatatacaacagagttttcccaccaaagaaaaagcacataagcatgaaccacaaaagaaaagttaccgaaaaaaatctgttgaaatgaaacataggaaagtctatgtagaaaagaaacttttgaaatgtaatgattgtgagaaagtcttcaaccagagctcatcccttactcttcatcagagaattcatactggagagaaaccctatgcatgtgttgaatgtgggaaaacgttcagccagagtgcaaacttggcgcaacataagagaatacatactggagagaaaccctatgaatgtaaagaatgtaggaaagccttcagccagaatgcacacctggcccaacatcagagagttcatactggagagaaaccttatcagtgtaaagaatgtaaaaaagccttcagccagattgcacacctgactcagcatcagagagttcatactggagagagacctttcgaatgtattgaatgtggaaaggcctttagtaatggttcatttcttgctcagcatcagagaattcatacaggagagaaaccttatgtgtgtaatgtgtgtgggaaagcctttagccatcgtggatacctaattgtacatcagagaattcatactggagagagaccctacgaatgtaaggaatgtaggaaagccttcagccagtatgcacaccttgctcaacatcagagagttcatactggagaaaaaccttatgaatgtaaagtatgtaggaaagccttcagccaaattgcataccttgatcaacatcagagggttcatactggagagaaaccctatgaatgtattgaatgtgggaaggcctttagcaatagttcatcacttgcacaacatcagagaagtcatactggagaaaaaccctatatgtgtaaggaatgtaggaaaacatttagccagaatgcaggccttgctcaacatcagagaattcatactggagagaaaccttatgaatgtaatgtttgtgggaaagcatttagctatagtggatctcttactctacatcagagaattcatactggagaaagaccctatgaatgtaaagattgcaggaaatctttcaggcagcgtgcacatcttgctcatcatgagagaattcatactatggagtcattcttgactctttcctctccctcaccctccacatcaaatcagttgccaagacctgtaggtttcatctcctgaatatttctggaatccacctcttgaatccatttccatcccatcatccttgtccaatgcacattaatatatttgacatgggatactcgagtagctttctaattggtctccttgtactcaccattgtctctgtcagatgtccacattgcaaccaaatttgtatttttaaaaatatgtttaatctcatttctccctcattaaaatccctcagtggcatcccatggtttttaagttaaagcacacattcttcaaaatagcctaaaaacctagcctctaacaccttgttccaggttaccttccaaagtttctatcttgtgtcactatccatctcattctctgaatacttatccaggattaagatacatattccaggatcaaaaagacctgggttccaatctttgcacttccatttcctgccctctaatttgggggcagcagtttgtgctttgtaagcttcagtcttatttatagtgtgggaataataatggttctacctcagaagttaatagaagaatgaaataatgcatgtaaattgctcagcagcgtgcctagcataaagtaattactcaaaccataatgtaaagtaaaaagataaccatactatacatagaaagccaatcatctcagccatgattatctcagaaataaaaagagatgcagcagctcaggactgagagattgtgaagtttttttttttttaggaatggtaggcatttttctaaaagtaggtgaggagggtatctaacagtaggatttacattagagtccatgatatagggtaagatggtggcttgtatcagcattcactggatatttaacagttctaagatgctaatgtcttattttaaaagtctttttttttgagatggagtcttgctctgttgctcaggcttgagtgcagtagtgcaatcttggctcactgcaacctccgcctcctgtgttcaagtgattctcctgcctcagcctcctgagtagctgggattacaggcctgcaccaccacgcccagctaatttttgtatttttagtagagagagggttttgacatgtcggccaggcttttctctaactcctgacgtccggtgatccgcctgccttggcctcccaaagtgctgggattacatgcgtgagctaccgtgcctggcctaaaaagtcatttttaataagacagtttactgagatgtattcatcatttacatgtaaacaaaggcaaaatcgaaattaaaaagaaatcttgaaacaagtcagtaaccaatgatgagtagaaaataaagtataagtttgaacccctgttctaaatctgggtgaatgaattatatcaaatctatgtcatttaaaataataaaggttgttaaattactaaaatttcaaaactagtgaagaaaagaaaccaaaactgtaggtcagttctcataaactggcccacaaacatgtttgattctgtatgcattaagtttaaaatacatatgaataccttcagcagaccatgtgttttccctttctccaacattcaaaccactccctgattctttacatctgacctcttttaatattacttcctgaccccagaattcttttggcatataatcaatgcagtgatcaattcacatgtgactatagatacaaacagaatgacgaaagtttaatggaggatgaaaaagaagacaaataaatattttatcctttatatggtaagacagattcactatcatactgatgtcagtagcccatgaattaatttacagattctacctaacaaaattctaataaattttgtaaggttttaacatgtatgtgtgaacatacatattcatgctgttacacatataaagaaaattataacaaaagtgacctataccatcagtggtttaacagttttggaaaaatttatcgtgctctatacaacaattcattccatatgtgaaagttactttcaagtgctttatctaaatgtggaacaaacagtgattagaggagtctgtgacacactctaatcatggaatgagactggccttcctaaacatgagattcagaagcctccccacctcctgtcaacaagtcatagatttgactgtataagaactttataaagcttttatatgatcaaagatagtaaaagatacaatattttttaaacctaagaatgggagaaaattattgcagcacatataaactatggaattcatatccttaacataaaattgctcataaaaatcccttaggaaatgacgcttttctccagctcatagtcaaaggatatgaagaggcaacaggtgaccaataaatatgtggtaagtactaaatctccctaggatcagaagaaatacagtttaggccaatgaaatactatttttttcaatatcagattaataaaactgcattgaaagcatacaaaaagagatactatgcactaatttaaaagagcatgagtttgtacaaactctggtaggcaatttgtcaacttcagaattttaattgggaaaagtagaattttattttgaagttcaaaaactcggcacacaatgtctttccctccagattctattatacacatagaacaatgtaaatgattcttaaaaaaaaaaaaaaggtgaggcttttgagtggatgaaataattttgtaaaaggcaaaacagggaagagtgttcatgaattgtagcagaagatgctgcatgttatatgcgaatgaccgaagggttttaaaaatggaatctagtctgcccaaaggatccctagagaagttcaggcttggagttggcttatgtacaggctgtggcttctaagaagacatgatgaaaagcctcttgaagcctttgtatgtgaaagttatgtcagtagcccttgccaaaagcctcctcactctcccctctcttgtataagtaaattgaatgggatccttatttcacaccattaacaagtataagttctaactgaataaaaatctaaatgtaaattactaaagcaaaagtattagaaaaaatatagtgggatatgttaacga

SEQ ID NO: 203091 - DNA, 554 bp, Homo sapiens
  Payload ID: 20048
  Gene Name: zinc finger protein 583
  ENST ID: ENST00000537943
  CDS Start-End: 166-554
actgcgcgtgcgcctcaccgcgctggcaccccggcctggcagcctttggggacctgaaccagctgcgcctgcgcagctcgactttctcaggatactgtccctctcccacagaggagctgaaggagtaggacagaagaactgtcaaattctggaatccttaaagccatgtccaaggatttggtgacatttggggatgtggctgtaaatttctctcaagaggaatgggaatggctgaaccctgctcagaggaatttgtacaggaaagtgatgttggagaactacaggagcttggtatcattgggagtttctgtttctaagccagatgtgatctcattattggagcaaggaaaagagccctggatggtgaagaaggagggaacaagaggcccatgccctgattgggagtatgtatttaaaaacagtgaattttcatcaaagcaagagacatatgaagaatcatccaaagttgtgacagtgggagcaagacatcttagttatagccttgactatcccagtttgagagaagactgtcaaagtgaggactggtataagaa

SEQ ID NO: 203092 - DNA, 2332 bp, Homo sapiens
  Payload ID: 20049
  Gene Name: zinc finger protein 584
  Uniprot ID: Q8IVC4
  ENST ID: ENST00000306910
  CDS Start-End: 524-1789
gagctagcggcgccctcccttatcgccttggcaacgacccagccgcgccgcgaggagagccgggaatggaggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggaggctcagttggacccatcattgcagggcttggtgatgtttgaggatgtgacggtatatttctccagggaggagtgggggctccttaatgtgacccagaagggcctataccgggatgtgatgctggagaactttgcactcgttagctcactgggacttgcaccttcgagatcccctgtgtttacccagctggaggatgatgaacagtcgtgggtgcccagctgggtggatgtgactccagtcagcagagcagaagccaggagaggttttggtcttgatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaaccttcagtgttctgtctaccctcattcggcaccggaaagtgcacattggagaaaggccctatgagtgtacagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggcgtcaggaggacagggcacatgggaaggtcgttagctgctagcaccgtgttcatcaggaaaggtcttattccagaaaggaggttaaggagagtggccgtgagagtgccatccgaaagaagctaaaccttgcacatcccaacacccaccccagggagagttcccgtgtgtgcctggtgtgtgggacgctttcgggagccacattgcactctgacttgcctggggctgttggcagtgtcacatcactgagtttatccaccgccatccacctctatccaccccataaggtccctacagcaagtgggacagcagaccttgtgctccttgctctaaacagtagagaatcgttaatagtggagcccaaaacaggcctcattccctacccttgactggtttagctgtggacatgacccacctctggccggaggagctgagctggtatctgctgggggcttcctgggaaggtttaccattttcatggaaatggttgacattacacatggtatttgtcatgccctagcatggactgtctcatactgctctggactatgtggtaataaaggctttattgtttaagccgcttaaaa

SEQ ID NO: 203093 - DNA, 1042 bp, Homo sapiens
  Payload ID: 20049
  Gene Name: zinc finger protein 584
  ENST ID: ENST00000322834
  CDS Start-End: 372-809
agtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggagggcttggtgatgtttgaggatgtgacggtatatttctccagggaggagtgggggctccttaatgtgacccagaagggcctataccgggatgtgatgctggagaactttgcactcgttagctcactgggacttgcaccttcgagatcccctgtgtttacccagctggaggatgatgaacagtcgtgggtgcccagctgggtggatgtgactccagtcagcagagcagaagccaggagaggttttggtcttggccccgcatgttcctgcctctctggcctgcgtctcctcattgcccttctctgtatctgtgcagagctgtctactgttggcgactcagtgcgtgtcttgaaatgtgcacatatccttaaacagatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaaca

SEQ ID NO: 203094 - DNA, 2288 bp, Homo sapiens
  Payload ID: 20049
  Gene Name: zinc finger protein 584
  ENST ID: ENST00000599238
  CDS Start-End: 467-748
gttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggagggaggagtgggggctccttaatgtgacccagaagggcctataccgggatgtgatgctggagaactttgcactcgttagctcactgggacttgcaccttcgagatcccctgtgtttacccagctggaggatgatgaacagtcgtgggtgcccagctgggtggatgtgactccagtcagcagagcagaagccaggagaggttttggtcttgtctgccatctctaccatgattttcaggccccgcatgttcctgcctctctggcctgcgtctcctcattgcccttctctgtatctgtgcagagctgtctactgttggcgactcagtgcgtgtcttgaaatgtgcacatatccttaaacagatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaaccttcagtgttctgtctaccctcattcggcaccggaaagtgcacattggagaaaggccctatgagtgtacagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggcgtcaggaggacagggcacatgggaaggtcgttagctgctagcaccgtgttcatcaggaaaggtcttattccagaaaggaggttaaggagagtggccgtgagagtgccatccgaaagaagctaaaccttgcacatcccaacacccaccccagggagagttcccgtgtgtgcctggtgtgtgggacgctttcgggagccacattgcactctgacttgcctggggctgttggcagtgtcacatcactgagtttatccaccgccatccacctctatccaccccataaggtccctacagcaagtgggacagcagaccttgtgctccttgctctaaacagtagagaatcgttaatagtggagcccaaaacaggcctcattccctacccttgactggtttagctgtggacatgacccacctctggccggaggagctgagctggtatctgctgggggcttcctgggaaggtttaccattttcatggaaatggttgacattacacatggtatttgtcatgccctagcatggactgtctcatactgctctggactatgtggtaataaaggctttattgtttaagccgcttaaaa

SEQ ID NO: 203095 - DNA, 2187 bp, Homo sapiens
  Payload ID: 20049
  Gene Name: zinc finger protein 584
  ENST ID: ENST00000593920
  CDS Start-End: 531-1661
gaatggaggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggagggaggagtgggggctccttaatgtgacccagaagggcctataccgggatgtgatgctggagaactttgcactcgttagctcactgggacttgcaccttcgagatcccctgtgtttacccagctggaggatgatgaacagtcgtgggtgcccagctgggtggatgtgactccagtcagcagagcagaagccaggagaggttttggtcttgatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaaccttcagtgttctgtctaccctcattcggcaccggaaagtgcacattggagaaaggccctatgagtgtacagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggcgtcaggaggacagggcacatgggaaggtcgttagctgctagcaccgtgttcatcaggaaaggtcttattccagaaaggaggttaaggagagtggccgtgagagtgccatccgaaagaagctaaaccttgcacatcccaacacccaccccagggagagttcccgtgtgtgcctggtgtgtgggacgctttcgggagccacattgcactctgacttgcctggggctgttggcagtgtcacatcactgagtttatccaccgccatccacctctatccaccccataaggtccctacagcaagtgggacagcagaccttgtgctccttgctctaaacagtagagaatcgttaatagtggagcccaaaacaggcctcattccctacccttgactggtttagctgtggacatgacccacctctggccggaggagctgagctggtatctgctgggggcttcctgggaaggtttaccattttcatggaaatggttgacattacacatggtatttgtcatgccctagcatggactgtctcatactgctctggactatgtggtaataaaggctttatt

SEQ ID NO: 203096 - DNA, 575 bp, Homo sapiens
  Payload ID: 20049
  Gene Name: zinc finger protein 584
  ENST ID: ENST00000596281
  CDS Start-End: 460-558
aatggaggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggaggacttgcaccttcgagatcccctgtgtttacccagctggaggatgatgaacagtcgtgggtgcccagctgggtggatgtgactccagtcagcagagca

SEQ ID NO: 203097 - DNA, 562 bp, Homo sapiens
  Payload ID: 20049
  Gene Name: zinc finger protein 584
  ENST ID: ENST00000598901
  CDS Start-End: 475-562
gcgaggagagccgggaatggaggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggaggtgagcagaggatgcctccgaggaatgagggggcccaccaggacttgcaccttcgagatcccctgtgttt

SEQ ID NO: 203098 - DNA, 8618 bp, Homo sapiens
  Payload ID: 20050
  Gene Name: zinc finger protein 585A
  Uniprot ID: Q6P3V2
  ENST ID: ENST00000292841
  CDS Start-End: 260-2569
agcctacaaaggggaggtgctagaagtcggaccggaagtggaagtggtcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccaggagagaaattatgggaccataatcaatgtagaaaaatcctcagttataaacaagtatcctctcaacctcaaaaaatgtatcctggggagaaagcttatgaatgcgccaaatttgaaaagatattcacccagaagtcacagctcaaagtacacctgaaagttcttgcaggagaaaagctctatgtatgcattgaatgtgggaaggcttttgtacagaagccagaatttattatacaccagaaaacccatatgagagagaaaccctttaaatgcaatgaatgtggaaaatccttttttcaagtgtcgtccctcttcaggcatcagagaattcataccggagagaaactctatgaatgcagccagtgtgggaaaggcttctcttataactcagatctcagtatacatgagaaaattcatactggagagagacaccatgaatgcactgactgtggcaaagcattcacacaaaagtccacactcaagatgcatcagaaaatccatacaggcgagagatcctacatctgtattgaatgcggacaggccttcatccagaagacccatttgattgcacaccgaagaattcatactggagaaaaaccatatgagtgcagtaactgtggcaaatccttcatttccaagtcacaacttcaggtacatcaacgtgttcacacaagagtgaagccctatatatgtaccgaatatgggaaggtcttcagcaataattccaacctcgttacacataagaaagttcaaagtagagagaaatcttccatatgtactgagtgtgggaaggcctttacctacaggtcagagttgattattcatcagagaattcacactggagagaaaccttatgaatgcagtgactgtgggaaagccttcactcagaagtcagcactcacagtgcatcagagaattcatacaggagaaaaatcgtatatatgcatgaaatgtggactggccttcattcagaaggcacacttgattgcacatcaaataattcatactggagagaaacctcataaatgtggtcactgtgggaaattgtttacctccaagtcgcaactccatgttcataaacgaattcacacaggagaaaagccctatatgtgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagccttcactcagaagtcacacctcaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgcgggaaggcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgtgggaaaggcttcgttcagaaatcagtgttcagcgtccatcagagcagccacgcttgagagaaacagtgtgagaaaacccccctgagggttgggtctgattgtacactgttgcacgcatgcagcagaaaaatatgtatattattgtaaatagaaatgaccacagcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcctaagaaagatcgtattaagttaacgataatcctgtttactgtggattaggtatagtgccaacaaattgaatgataaaacaacataatacgtagttattttgatagtgatgaatcctaagttatgtgagttgttcgttgtggaacacattgtgtaacagactcctgggtgtttttctttctcattcgaatctaccacagttggtcatatccaaccctcattcagtatttctatcaagaaagagatgctacaaaaaaaaaaagaaaaaacctttatgtatacagacgtaaacctcagaatgtatgttgagtccccactgtcatctaccaagacttgcacccccctcattatctaccatgactgtctctcagcctcacgggccctcagcactttgtgttttgacccccagcaccgtgtcttgtgaactcccatcaccttcaagaaagcttccgaggtaagaattttatggtcatctgggacaacttaaatctcccttctgctgtcatagttcttccaactcagttgcctttttttttttttcgtactcatcactgacttgaagcttagtatctggcttccttaaggatgtaactttcatgtaacagattaataacttatatgaaaaccaacacaaccatatgtttagggctggaaagggccatgacgcctggccatttttcctgttttaccttactcttatgtgtgtcacacttcatcaattccggaaacagtttctggagatctcctcattacctcttttacaatcacctcactccagcatggtgtctgttacctcttcccacttgtgacaatgtctagtaaggtccactctccattctgtgtgatgaccacttattacaaccctcagaataggggacagtggtgtgccccctgcaatacaatggtttctatctcctgatacttttattacacctctagcaggatgtcttgtgatcctccttattgatttttccctcacgatgatgaacaattatctcccgttactcacctagcagtatctaactgtccctaacacagcatgtgggaatgccctcaatacggtggatgctgttaactttcttccttcccctcaggcaatggcggtgacttacaatgaaccataatgtccacatttcccaactgtattttggagcctcttctgtccccttctttctaggaccccagttaaaaaaaaaaaaaacaaaaactagcccaatgtctgttgatgcccattaatcactaacacagtgtctgacccctccattaaattttgatggtatctcttggctccccattgtcccgttaacccaatgtctgctgattcccaatttcccacattgcttcatgcggttccttagtcacccttggctactgtacttcccccaagattgcatctccatgtttgcatggtcatgatccctggaagatggtgatgaggatgaggtcccagcctcatagaccttttcctctgagttccccccaaggcacaatggaatgatggacccagggtgggccagggatgatctggagatctcaggagaccacaagctgggcttcctgtctactacatgagtatggtgtgagcagaacagtgaaagctgtctatgttggttcaaattctggtgccaacactgatccacttagggaccctcagcctgcccagaaacctcctctgggcctcaattttctcacttgtaaaatgggattatgggagaatgaagtgactttttttgggtcacatgatggatgggatccaagccagcagggcccaatgacagcatcctgttaatattagtcatcagtcaacataagcatctgactatcctctgtatgcccaagcctcatgaagggaaacaatttattgtaaatgacttttgattatttctcttatatatttattgtaacaatattataatacttacgtatatgtatatgcatatacccgtatatacggaaggctttattttttagagtagttttaggttcaaagcaaaattgggtagaaattacagaggtttcccatatatcccctaatccacatatgcatagcctcccacattatcagcattcctctcagagtagtatatttgttacaattggtgaacctccactgacactcattaccaccccaagtctataggttatattagggttcatccttggtgtaacaccatagaatgtgtcttgtactttctgcttgttggagcaagtggatcatggcatgtttccactgttatacacagagtagtttcactgccctaaaaatcctctgtgttctgcctgtcatcccttcatctcctctaatcctggcaacattttttctgtctccatagttttacctttgatcttttatatcatatagttgaaattatacagtgtgtagccttttcaaattgacttctttcacttagtaatgtggatttcagtttcctccatgtcttttcatggcttgataatgcatttctttttagagccaaattatgttccatcgtctggatgtttatttattcacctactgaaggactgttggatgcttccttttggcaattatgaggaaagctgttataaatatctgtgcaggctttttgtgtggacataactgaaatatttttaaagttatatttattgaggtataatttacattcagtaatagtcacactttttagtgtagagttctgagttttgacagttgtatctaatcatgcaatcaacaccacaatcaagatgaagaacaggcccctcacttccctaacttctttcctatccctttttagtcccttttcccactcccagcccttggcaatcaccagtctgtttccgtctctatagttctgccttttccataatattgtataagtggagtccttgtgtgtgtgtgtgtgtgtgtgtgtgttttgtacgtgtatgtatatctccttttgagtcggagtgctttcatttaatgtgatgtatctgagattcatccatatggttctatgaaaaacaaatggaaaataaggtgatgaaaagatgctcaacatctttaattatcaggaaaatgtaaatcaaaccacaatgagatactactatagaatggcttttagaatggctaaaaatgaaaacgtgccataaattggcaagaatacagaccaatggaaattttcatgcattgcttgtaggattgtaaaacggtctgtccactatgcacaaaagtttggcagcttcttatactattaaccatacatttatcatatgactcagcaactccacacttaggtatttaccctagatgaaagaaaaattctgtttacatgaaaacctatactcagatgttcacagcaattgtataattgcccaaattaggaagtaacacaaatgtacatcagtggatgagtgattaaacaaattgtgtacaccaatactatggagggctgctcagacataaagaaatgatttattgacacttactacaacatggatgaatctcaaaagtgctgttgtattttaggtaaaccatgtgataacttgaattacatttgataaaagatttataagtgtaaaaactagatttatatattttaattttatatgtgcctgtcattacatactatagaaaattgtgtctacagtatgttatatagcatattgtaatatttattactgtatattccttgtgacaataaaatagtttgtattttatataatagtacctgttttatagtatatgttttattttatatgattacctaattttaatattttacatatcaaactttcacataatattttggttatttctactttcacgtagttgcatttaatgtttgtagtgtaaagatataactacaataaaagaggccagagagtctgcagttggagttagtcaacatttttatttgtcaggcatctcaattctggctgttttaacatcaaggatcttttctctggctttgggcctttgcaccgactgttctgagagtgctctgcttctccagtgcccgtgcatcttgctttcctcttccacctttgcagtgcctccatccccatcttatcctgccattgaagtaacacatctgtagagctcacttgctgctcccttattttgtatgatatttgcattgcaaatactattactatctgacctgattcaatattcctttttttggtttctcatccctcttccccactggaccatcagcctcatgagaaccagactttgtctgtcctgtttctgctgtataccaggcgcccagcacggtgccagctcaaagcagatgctcagtacaagcttgttaaatggatgaatgaataatagcaataatatcgaggttgaccagatgccccgcacagattggtaacatgtgtggggaagttggtggggtgggtttgggtcctctaattcaagatttaatgcctcctcccaccatggtccagcacacccagctctaactccatgtcagggcagtaccaaactgagtatcctacctacatacattccacactgtttacaagatctaacttagcctcctcctggtcacagtggcaggtcacatagagggggaaaggggcaggagtgggggatccataggcagggggccactcccatcagcatctagcctagcactttctatcctgcaccccattgtcagtgtcacctgccccacctcctccactggagcagccactggaaaatatagaaccccaggagcaagaggaatgtggcagggctgagggttctggggctcaggcaccttgttggataatggatgtgatgcagtgtggcagacattgaccccgtggccaaagtcagcttaaagccaaggttgtcatggacacttcccataatgccaggatgaatcacaccctccaccctcagctctcaaatgggctactagtgccaatgtgactattttttatttttattttttttgagatggagtctcactctgttgccaggctggagtgcagtggtgtgatcttggctcactgcaacctctgcctcccgggttcaagtgattctcctgcctcagcctccgagtagctgcgattacaggcacccaccaccacacccagctaattttttgtatttttagtagagatggggtttcaccatgttggccaggatggtctcaatctcctgacctcacgatttgcccacctcggccacccaaagcattgggattacaggcctgagccacctcgcccaacccagtgtgactatttatggtatatcctacacctccccaccacactctactccacattcctcataccgtaccataccgtacaccatgccatagcataccacttacagttttacttaattctataattatattgtttctattaatggttttaaatataatcaacacaattatactttataacaaatatcagaatccttgtcattattatatgcctctaaattattaagatatcataaataacaacatatcaattctgatgctaagaaatcctctgtctctgctagtttctgccaccttcaggtgtttgtattatataaacacagtagtcccacccctgggctgatgttttccaccctctgtgaaatcagcacaattaggttacatccttagtgattttattatggtgttattttaatatttattataacaaggaatgctgctattaaaacaaaaaattgtgctctctgtttacatttgtgaaataggacaatataagaagcacattagtacaatcatttgagttatattaagtttgtgcctataataaatgccaatcctgaaaa
